United States Patent
Tremblay et al.

(10) Patent No.: US 11,149,276 B2
(45) Date of Patent: Oct. 19, 2021

(54) PATATIN-LIKE PHOSPHOLIPASE DOMAIN CONTAINING 3 (PNPLA3) IRNA COMPOSITIONS AND METHODS OF USE THEREOF

(71) Applicant: Alnylam Pharmaceuticals, Inc., Cambridge, MA (US)

(72) Inventors: Frederic Tremblay, Boston, MA (US); James D. McIninch, Burlington, MA (US); Adam Castoreno, Framingham, MA (US); Mark K. Schlegel, Boston, MA (US); Charalambos Kaittanis, Cambridge, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 53 days.

(21) Appl. No.: 17/182,348

(22) Filed: Feb. 23, 2021

(65) Prior Publication Data
US 2021/0189400 A1   Jun. 24, 2021

Related U.S. Application Data

(63) Continuation of application No. PCT/US2020/064776, filed on Dec. 14, 2020.

(60) Provisional application No. 63/040,602, filed on Jun. 18, 2020, provisional application No. 62/948,445, filed on Dec. 16, 2019.

(51) Int. Cl.
*C12N 15/113*    (2010.01)
*A61K 47/02*    (2006.01)
*A61K 9/08*    (2006.01)

(52) U.S. Cl.
CPC ............ *C12N 15/1137* (2013.01); *A61K 9/08* (2013.01); *A61K 47/02* (2013.01); *C12N 2310/14* (2013.01); *C12N 2310/315* (2013.01); *C12N 2310/3125* (2013.01); *C12N 2310/321* (2013.01); *C12N 2310/322* (2013.01); *C12N 2310/346* (2013.01); *C12N 2310/351* (2013.01)

(58) Field of Classification Search
None
See application file for complete search history.

(56) References Cited

U.S. PATENT DOCUMENTS

| | | | |
|---|---|---|---|
| 9,399,775 B2 | 7/2016 | Rajeev et al. | |
| 9,796,974 B2 | 10/2017 | Rajeev et al. | |
| 10,231,988 B2 | 3/2019 | Fitzgerald et al. | |
| 10,597,661 B2 | 3/2020 | Hinkle | |
| 2017/0340661 A1 | 11/2017 | Fitzgerald et al. | |
| 2018/0008724 A1 | 1/2018 | Rajeev et al. | |
| 2018/0201936 A1 | 7/2018 | Hinkle | |
| 2019/0216845 A1 | 7/2019 | Fitzgerald et al. | |
| 2020/0248188 A1 | 8/2020 | Hinkle | |

FOREIGN PATENT DOCUMENTS

WO   WO-2004048511 A2   6/2000

OTHER PUBLICATIONS

Kumashiro et al. "Role of patatin-like phospholipase domain-containing 3 on lipid-induced hepatic steatosis and insulin resistance in rats," Hepatology, vol. 57, No. 5, 2013.
Hao et al., "Shifts in dietary carbohydrate-lipid exposure regulate expression of the nonalcoholic fatty liver disease-associated gene PNPLA3/adiponutrin in mouse liver and HepG2 human liver cells," Metabolism—Clinical and Experimental (2014), vol. 63, Issue 10, 1352-1362.
"GalNAc-SiRNA with Enchanced stabilization chemistry: ESC-GalNAc-siRNA," Retrieved from the Internet: hhttp://www.alnylam.com/web/.../ALNY-ESC-GalNAc-siRNA-TIDES-May2014-Capella.pdf.
International Search Report and Written Opinion from PCT/US2016/017550 dated Aug. 5, 2016.
International Search Report and Written Opinion from PCT/US2016/051252 dated Feb. 6, 2017.
Min et al., "Metabolic profiling reveals that PNPLA3 induces widespread effects on metabolism beyond triacylglycerol remodeling in Huh-7 hepatoma cells," Am J Physiol Gastrointest Liver Physiol. 2014; 307(1):G-66-G76.
Database EMBL [Online] Sep. 12, 2011, "JP 2006507841-A/567366: Functional and Hyperfunctional siRNA.", retrieved from EBI accession No. EM_PAT:GB004957.
Nair et al. "Multivalent N-Acetylgalactosamine-Conjugated siRNA Localizes in Hepatocytes and Elicits Robust RNAi-Mediated Gene Silencing"J. Am. Chem. Soc. 2014, 136, 16958-16961.
Reynolds et al., "Rational siRNA design for RNA interference," Nature Biotechnology, vol. 22, pp. 326-330, 2004.

*Primary Examiner* — Tracy Vivlemore
(74) *Attorney, Agent, or Firm* — McCarter & English, LLP; Maria Laccotripe Zacharakis; Deborah L. Nagle

(57) ABSTRACT

The present invention relates to RNAi agents, e.g., double stranded RNA (dsRNA) agents, targeting the Patatin-Like Phospholipase Domain Containing 3 (PNPLA3) gene. The invention also relates to methods of using such RNAi agents to inhibit expression of a PNPLA3 gene and to methods of preventing and treating an PNPLA3-associated disorder, e.g., Nonalcoholic Fatty Liver Disease (NAFLD).

30 Claims, 7 Drawing Sheets
Specification includes a Sequence Listing.

PATATIN-LIKE PHOSPHOLIPASE DOMAIN CONTAINING 3 (PNPLA3) IRNA COMPOSITIONS AND METHODS OF USE THEREOF

RELATED APPLICATIONS

This application is a 35 § U.S.C. 111(a) continuation application which claims the benefit of priority to PCT/US2020/064776, filed on Dec. 14, 2020, which in turn claims the benefit of priority to U.S. Provisional Application No. 62/948,445, filed on Dec. 16, 2019, and U.S. Provisional Application No. 63/040,602, filed on Jun. 18, 2020. The entire contents of each of the foregoing applications are incorporated herein by reference.

SEQUENCE LISTING

The instant application contains a Sequence Listing which has been submitted electronically in ASCII format and is hereby incorporated by reference in its entirety. Said ASCII copy, created on Feb. 10, 2021 is named 121301_10603_SL.txt and is 1,097,214 bytes in size.

BACKGROUND OF THE INVENTION

The accumulation of excess triglyceride in the liver is known as hepatic steatosis (or fatty liver), and is associated with adverse metabolic consequences, including insulin resistance and dyslipidemia. Fatty liver is frequently found in subjects having excessive alcohol intake and subjects having obesity, diabetes, or hyperlipidemia. However, in the absence of excessive alcohol intake (>10 g/day), nonalcoholic fatty liver disease (NAFLD) can develop. NAFLD refers to a wide spectrum of liver diseases that can progress from simple fatty liver (steatosis), to nonalcoholic steatohepatitis (NASH), to cirrhosis (irreversible, advanced scarring of the liver). All of the stages of NAFLD have in common the accumulation of fat (fatty infiltration) in the liver cells (hepatocytes).

The NAFLD spectrum begins with and progress from its simplest stage, called simple fatty liver (steatosis). Simple fatty liver involves the accumulation of fat (triglyceride) in the liver cells with no inflammation (hepatitis) or scarring (fibrosis). The next stage and degree of severity in the NAFLD spectrum is NASH, which involves the accumulation of fat in the liver cells, as well as inflammation of the liver. The inflammatory cells destroy liver cells (hepatocellular necrosis), and NASH ultimately leads to scarring of the liver (fibrosis), followed by irreversible, advanced scarring (cirrhosis). Cirrhosis that is caused by NASH is the last and most severe stage in the NAFLD spectrum.

In 2008, a genomewide association study of individuals with proton magnetic resonance spectroscopy of the liver to evaluate hepatic fat content, a significant association was identified between hepatic fat content and the Patatin-like Phospholipase Domain Containing 3 (PNPLA3) gene (see, for example, Romeo et al. (2008) *Nat. Genet.*, 40(12):1461-1465). Studies with knock-in mice have demonstrated that expression of a sequence polymorphism (rs738409, I148M) in PNPLA3 causes NAFLD, and that the accumulation of catalytically inactive PNPLA3 on the surfaces of lipid droplets is associated with the accumulation of triglycerides in the liver (Smagris et al. (2015) *Hepatology,* 61:108-118). Specifically, the PNPLA3I148M variant was associated with promoting the development of fibrogenesis by activating the hedgehog (Hh) signaling pathway, leading to the activation and proflieration of hepatic stellate cells and excessive generation and deposition of extracellular matrix (Chen et al. (2015) *World J. Gastroenterol.,* 21(3):794-802).

Currently, treatments for NAFLD are directed towards weight loss and treatment of any secondary conditions, such as insulin resistance or dyslipidemia. To date, no pharmacologic treatments for NAFLD have been approved. Therefore, there is a need for therapies for subjects suffering from NAFLD.

SUMMARY OF THE INVENTION

The present invention provides iRNA compositions which affect the RNA-induced silencing complex (RISC)-mediated cleavage of RNA transcripts of a gene encoding Patatin-Like Phospholipase Domain Containing 3 (PNPLA3). The Patatin-Like Phospholipase Domain Containing 3 (PNPLA3) may be within a cell, e.g., a cell within a subject, such as a human subject.

In an aspect, the invention provides a double stranded ribonucleic acid (dsRNA) agent for inhibiting expression of Patatin-Like Phospholipase Domain Containing 3 (PNPLA3) in a cell, wherein the dsRNA agent comprises a sense strand and an antisense strand forming a double stranded region, wherein the sense strand comprises at least 15, e.g., 15, 16, 17, 18, 19, or 20, contiguous nucleotides differing by no more than 0, 1, 2, or 3 nucleotides from the nucleotide sequence of SEQ ID NO:1 and the antisense strand comprises at least 15, e.g., 15, 16, 17, 18, 19, or 20, contiguous nucleotides differing by no more than 1, 2, or 3 nucleotides from the nucleotide sequence of SEQ ID NO:2. In one embodiment, the dsRNA agent comprises at least one thermally destabilizing nucleotide modification, e.g., an abasic modification; a mismatch with the opposing nucleotide in the duplex; and destabilizing sugar modification, a 2'-deoxy modification, an acyclic nucleotide, an unlocked nucleic acids (UNA), or a glycerol nucleic acid (GNA), e.g., the antisense strand comprises at least one thermally destabilizing nucleotide modification.

In another aspect, the present invention provides a double stranded ribonucleic acid (dsRNA) for inhibiting expression of Patatin-Like Phospholipase Domain Containing 3 (PNPLA3) in a cell, wherein said dsRNA comprises a sense strand and an antisense strand forming a double stranded region, wherein the antisense strand comprises a region of complementarity to an mRNA encoding Patatin-Like Phospholipase Domain Containing 3 (PNPLA3), and wherein the region of complementarity comprises at least 15, e.g., 15, 16, 17, 18, 19, or 20, contiguous nucleotides differing by no more than 0, 1, 2, or 3 nucleotides from any one of the antisense nucleotide sequences in any one of Tables 2-11, 21, 24, 27, 30, 32, 33, 36, 37, 49 or 50.

In one aspect, the present invention provides a double stranded ribonucleic acid (dsRNA) for inhibiting expression of Patatin-Like Phospholipase Domain Containing 3 (PN-PLA3) in a cell, wherein said dsRNA comprises a sense strand and an antisense strand forming a double stranded region, wherein the sense strand comprises at least 15, e.g., 15, 16, 17, 18, 19, or 20, contiguous nucleotides differing by no more than 0, 1, 2, or 3 nucleotides from any one of the nucleotide sequence of nucleotides 677-721; 683-721; 773-817; 1185-1295; 1185-1241; 1202-1295; 1202-1241; 1255-1295; 1738-1792; 1901-1945; 1920-1945; 2108-2208; 2108-2166; 2108-2136, 2121-2166; 2121-2208; 2169-2208; 2176-2208; or 2239-2265 of the nucleotide sequence of SEQ ID NO:1, and the antisense strand comprises at least 19 contiguous nucleotides from the corresponding nucleotide sequence of SEQ ID NO:2.

In one aspect, the present invention provides a double stranded ribonucleic acid (dsRNA) for inhibiting expression of Patatin-Like Phospholipase Domain Containing 3 (PN-PLA3) in a cell, wherein said dsRNA comprises a sense strand and an antisense strand forming a double stranded region, wherein the sense strand comprises at least 15, e.g., 15, 16, 17, 18, 19, or 20, contiguous nucleotides differing by no more than 0, 1, 2, or 3 nucleotides from any one of the nucleotide sequence of nucleotides 574-596; 677-699; 683-705; 699-721; 773-795; 795-817; 1185-1207; 1192-1214; 1202-1224; 1208-1230; 1209-1231; 1210-1232; 1211-1233; 1212-1234; 1213-1233; 1214-1234; 1214-1236; 1215-1237; 1216-1238; 1219-1237; 1219-1241; 1255-1275; 1256-1276; 1257-1275; 1257-1277; 1258-1278; 1259-1279; 1260-1278; 1260-1280; 1261-1281; 1262-1282; 1263-1283; 1264-1282; 1264-1284; 1265-1285; 1267-1285; 1266-1286; 1266-1288; 1267-1285; 1267-1287; 1268-1290; 1269-1289; 1270-1290; 1271-1291; 1272-1292; 1273-1293; 1274-1294; 1275-1295; 1631-1653; 1738-1760; 1739-1761; 1740-1760; 1740-1762; 1741-1763; 1744-1766; 1746-1766; 1750-1772; 1751-1773; 1752-1774; 1753-1775; 1754-1776; 1755-1777; 1756-1778; 1757-1779; 1758-1780; 1759-1781; 1760-1782; 1761-1783; 1762-1782; 1762-1784; 1763-1785; 1764-1786; 1765-1787; 1766-1786; 1766-1788; 1767-1787; 1768-1788; 1767-1789; 1769-1789; 1770-1788; 1770-1790; 1771-1791; 1772-1792; 1815-1837; 1901-1923, 1920-1942, 1923-1945; 2112-2130; 2169-2191; 2171-2191; 2176-2198, 2177-2199, 2178-2200; 2179-2201; 2180-2202; 2181-2203; 2183-2205; 2184-2206; 2186-2208; 2239-2261; 2241-2263; 2242-2264; or 2243-2265 of the nucleotide sequence of SEQ ID NO:1, and the antisense strand comprises at least 19 contiguous nucleotides from the corresponding nucleotide sequence of SEQ ID NO:2.

In one embodiment, the antisense strand comprises at least 15, e.g., 15, 16, 17, 18, 19, or 20, contiguous nucleotides differing by nor more than 0, 1, 2, or 3 nucleotides from any one of the antisense strand nucleotide sequences of a duplex selected from the group consisting of AD-517197.2; AD-517258.2; AD-516748.2; AD-516851.2; AD-519351.2; AD-519754.2; AD-519828.2; AD-520018.2; AD-520035.2; AD-520062.2; AD-520064.2; AD-520065.2; AD-520067.2; AD-75289.2; AD-520069.2; AD-520099.2; AD-67575.7; AD-520101.2; AD-67605.7; AD-1193323.1; AD-1193344.1; AD-1193350.1; AD-1193365.1; AD-1193379.1; AD-1193407.1; AD-1193421.1; AD-1193422.1; AD-1193429.1; AD-1193437.1; AD-1193443.1; AD-1193471.1; and AD-1193481.1.

In one embodiment, the antisense strand comprises at least 15, e.g., 15, 16, 17, 18, 19, or 20, contiguous nucleotides differing by nor more than 0, 1, 2, or 3 nucleotides from any one of the antisense strand nucleotide sequences of a duplex selected from the group consisting of AD-519345.1, AD-519346.1, AD-519347.1, AD-67554.7, AD-519752.3, AD-1010731.1, AD-1010732.1, AD-519343.1, AD-519344.1, AD-519349.1, AD-519350.1, AD-519753.2, AD-519932.1, AD-519935.2, AD-520018.6, AD-517837.2, AD-805635.2, AD-519329.2, AD-520063.2, AD-519757.2, AD-805631.2, AD-516917.2, AD-516828.2, AD-518983.2, AD-805636.2, AD-519754.7, AD-520062.2, AD-67575.9, AD-518923.3, AD-520053.4, AD-519667.2, AD-519773.2, AD-519354.2, AD-520060.4, AD-520061.4, AD-1010733.2, AD-1010735.2; AD-1193323.1; AD-1193344.1; AD-1193350.1; AD-1193365.1; AD-1193379.1; AD-1193407.1; AD-1193421.1; AD-1193422.1; AD-1193429.1; AD-1193437.1; AD-1193443.1; AD-1193471.1; and AD-1193481.1.

In one embodiment, the antisense strand comprises at least 15, e.g., 15, 16, 17, 18, 19, or 20, contiguous nucleotides differing by nor more than 0, 1, 2, or 3 nucleotides from any one of the antisense strand nucleotide sequences of duplex AD-519351.

In one embodiment, the dsRNA agent comprises at least one modified nucleotide.

In one embodiment, substantially all of the nucleotides of the sense strand; substantially all of the nucleotides of the antisense strand comprise a modification; or substantially all of the nucleotides of the sense strand and substantially all of the nucleotides of the antisense strand comprise a modification.

In one embodiment, all of the nucleotides of the sense strand comprise a modification; all of the nucleotides of the antisense strand comprise a modification; or all of the nucleotides of the sense strand and all of the nucleotides of the antisense strand comprise a modification.

In one embodiment, at least one of the modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a thermally destabilizing nucleotide, a glycol modified nucleotide (GNA), and a 2-O—(N-methylacetamide) modified nucleotide; and combinations thereof.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and glycol; and combinations thereof.

In one embodiment, at least one of the modified nucleotides is selected from the group consisting of a deoxynucleotide, a 2'-O-methyl modified nucleotide, a 2'-fluoro modified nucleotide, a 2'-deoxy-modified nucleotide, a glycol modified nucleotide (GNA), e.g., Ggn, Cgn, Tgn, or Agn, and, a vinyl-phosphonate nucleotide; and combinations thereof.

In another embodiment, at least one of the modifications on the nucleotides is a thermally destabilizing nucleotide modification.

In one embodiment, the thermally destabilizing nucleotide modification is selected from the group consisting of an abasic modification; a mismatch with the opposing nucleotide in the duplex; and destabilizing sugar modification, a 2'-deoxy modification, an acyclic nucleotide, an unlocked nucleic acids (UNA), and a glycerol nucleic acid (GNA).

In some embodiments, the modified nucleotide comprises a short sequence of 3'-terminal deoxy-thymine nucleotides (dT).

In some embodiments, the modifications on the nucleotides are 2'-O-methyl, GNA and 2'fluoro modifications.

In some embodiments, the dsRNA agent further comprises at least one phosphorothioate internucleotide linkage. In some embodiments, the dsRNA agent comprises 6-8 phosphorothioate internucleotide linkages. In one embodiment, the phosphorothioate or methylphosphonate internucleotide linkage is at the 3'-terminus of one strand. Optionally, the strand is the antisense strand. In another embodiment, the strand is the sense strand. In a related embodiment, the phosphorothioate or methylphosphonate internucleotide linkage is at the 5'-terminus of one strand. Optionally, the strand is the antisense strand. In another embodiment, the strand is the sense strand. In another embodiment, the phosphorothioate or methylphosphonate internucleotide linkage is at the both the 5'- and 3'-terminus of one strand. Optionally, the strand is the antisense strand. In another embodiment, the strand is the sense strand.

The double stranded region may be 19-30 nucleotide pairs in length; 19-25 nucleotide pairs in length; 19-23 nucleotide pairs in length; 23-27 nucleotide pairs in length; or 21-23 nucleotide pairs in length.

In one embodiment, each strand is independently no more than 30 nucleotides in length.

In one embodiment, the sense strand is 21 nucleotides in length and the antisense strand is 23 nucleotides in length.

The region of complementarity may be at least 17 nucleotides in length; between 19 and 23 nucleotides in length; or 19 nucleotides in length.

In one embodiment, at least one strand comprises a 3' overhang of at least 1 nucleotide. In another embodiment, at least one strand comprises a 3' overhang of at least 2 nucleotides.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

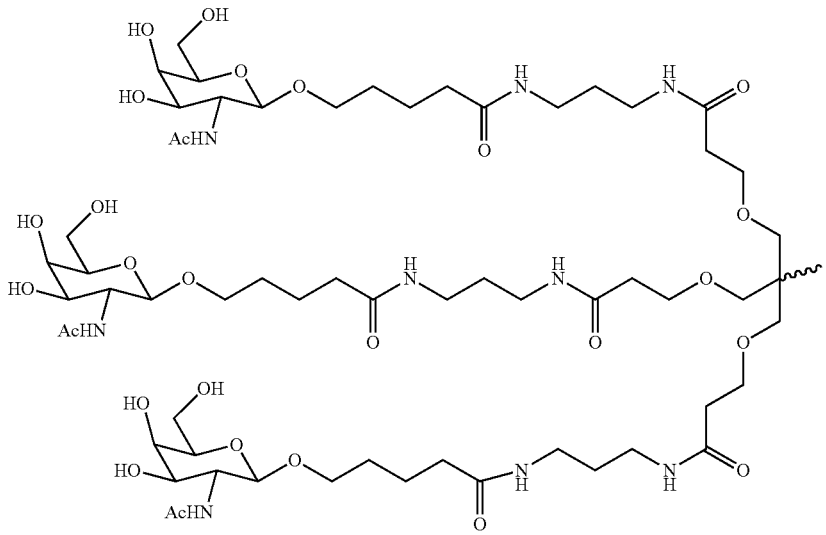

In one embodiment, the dsRNA agent is conjugated to the ligand as shown in the following schematic

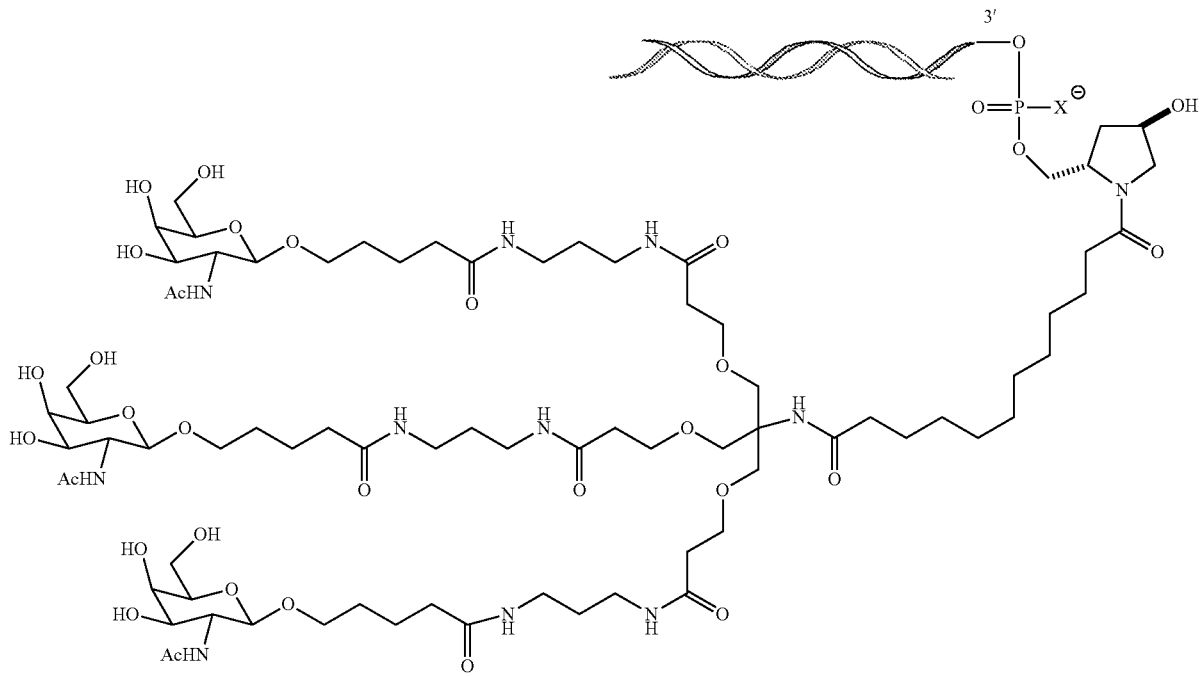

and, wherein X is O or S.

In one embodiment, the X is O.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand, e.g., the antisense strand or the sense strand.

In another embodiment, the phosphorothioate or methylphosphonate internucleotide linkage is at the 5'-terminus of one strand, e.g., the antisense strand or the sense strand.

In one embodiment, the phosphorothioate or methylphosphonate internucleotide linkage is at the both the 5'- and 3'-terminus of one strand. In one embodiment, the strand is the antisense strand.

In one embodiment, the base pair at the 1 position of the 5'-end of the antisense strand of the duplex is an AU base pair.

The present invention also provides cells containing any of the dsRNA agents of the invention and pharmaceutical compositions comprising any of the dsRNA agents of the invention.

The pharmaceutical composition of the invention may include dsRNA agent in an unbuffered solution, e.g., saline or water, or the pharmaceutical composition of the invention may include the dsRNA agent is in a buffer solution, e.g., a buffer solution comprising acetate, citrate, prolamine, carbonate, or phosphate or any combination thereof; or phosphate buffered saline (PBS).

In one aspect, the present invention provides a method of inhibiting expression of a Patatin-Like Phospholipase Domain Containing 3 (PNPLA3) gene in a cell. The method includes contacting the cell with any of the dsRNAs of the invention or any of the pharmaceutical compositions of the invention, thereby inhibiting expression of the PNPLA3 gene in the cell.

In one embodiment, the cell is within a subject, e.g., a human subject, e.g., a subject having a Patatin-Like Phospholipase Domain Containing 3 (PNPLA3)-associated disorder, such as a Patatin-Like Phospholipase Domain Containing 3 (PNPLA3)-associated disorder selected from the group consisting of fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD).

In one embodiment, contacting the cell with the dsRNA agent inhibits the expression of PNPLA3 by at least 50%, 60%, 70%, 80%, 90%, or 95%.

In one embodiment, inhibiting expression of PNPLA3 decreases PNPLA3 protein level in serum of the subject by at least 50%, 60%, 70%, 80%, 90%, or 95%.

In one aspect, the present invention provides a method of treating a subject having a disorder that would benefit from reduction in Patatin-Like Phospholipase Domain Containing 3 (PNPLA3) expression. The method includes administering to the subject a therapeutically effective amount of any of the dsRNAs of the invention or any of the pharmaceutical compositions of the invention, thereby treating the subject having the disorder that would benefit from reduction in PNPLA3 expression.

In another aspect, the present invention provides a method of preventing at least one symptom in a subject having a disorder that would benefit from reduction in Patatin-Like Phospholipase Domain Containing 3 (PNPLA3) expression. The method includes administering to the subject a prophylactically effective amount of any of the dsRNAs of the invention or any of the pharmaceutical compositions of the invention, thereby preventing at least one symptom in the subject having the disorder that would benefit from reduction in PNPLA3 expression.

In one embodiment, the disorder is a Patatin-Like Phospholipase Domain Containing 3 (PNPLA3)-associated disorder, e.g., a Patatin-Like Phospholipase Domain Containing 3 (PNPLA3)-associated disorder is selected from the group consisting of fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD).

In one embodiment, the PNPLA3-associated disorder is NAFLD.

In one embodiment, the subject is human.

In one embodiment, the dsRNA agent is administered to the subject at a dose of about 0.01 mg/kg to about 50 mg/kg.

In one embodiment, the dsRNA agent is administered to the subject subcutaneously.

In one embodiment, the methods of the invention include further determining the level of PNPLA3 in a sample(s) from the subject.

In one embodiment, the level of Patatin-Like Phospholipase Domain Containing 3 (PNPLA3) in the subject sample(s) is a Patatin-Like Phospholipase Domain Containing 3 (PNPLA3) protein level in a blood or serum sample(s).

In certain embodiments, the methods of the invention further comprise administering to the subject an additional therapeutic agent. In a further embodiment, the additional therapeutic agent is selected from the group consisting of an HMG-CoA reductase inhibitor, a fibrate, a bile acid sequestrant, niacin, an antiplatelet agent, an angiotensin converting enzyme inhibitor, an angiotensin II receptor antagonist, an acylCoA cholesterol acetyltransferase (ACAT) inhibitor, a cholesterol absorption inhibitor, a cholesterol ester transfer protein (CETP) inhibitor, a microsomal triglyceride transfer protein (MTTP) inhibitor, a cholesterol modulator, a bile acid modulator, a peroxisome proliferation activated receptor (PPAR) agonist, a gene-based therapy, a composite vascular protectant, a glycoprotein IIb/IIIa inhibitor, aspirin or an aspirin-like compound, an IBAT inhibitor, a squalene synthase inhibitor, a monocyte chemoattractant protein (MCP)-I inhibitor, or fish oil.

The present invention also provides kits comprising any of the dsRNAs of the invention or any of the pharmaceutical compositions of the invention, and optionally, instructions for use.

DETAILED DESCRIPTION OF THE INVENTION

Figure 1:
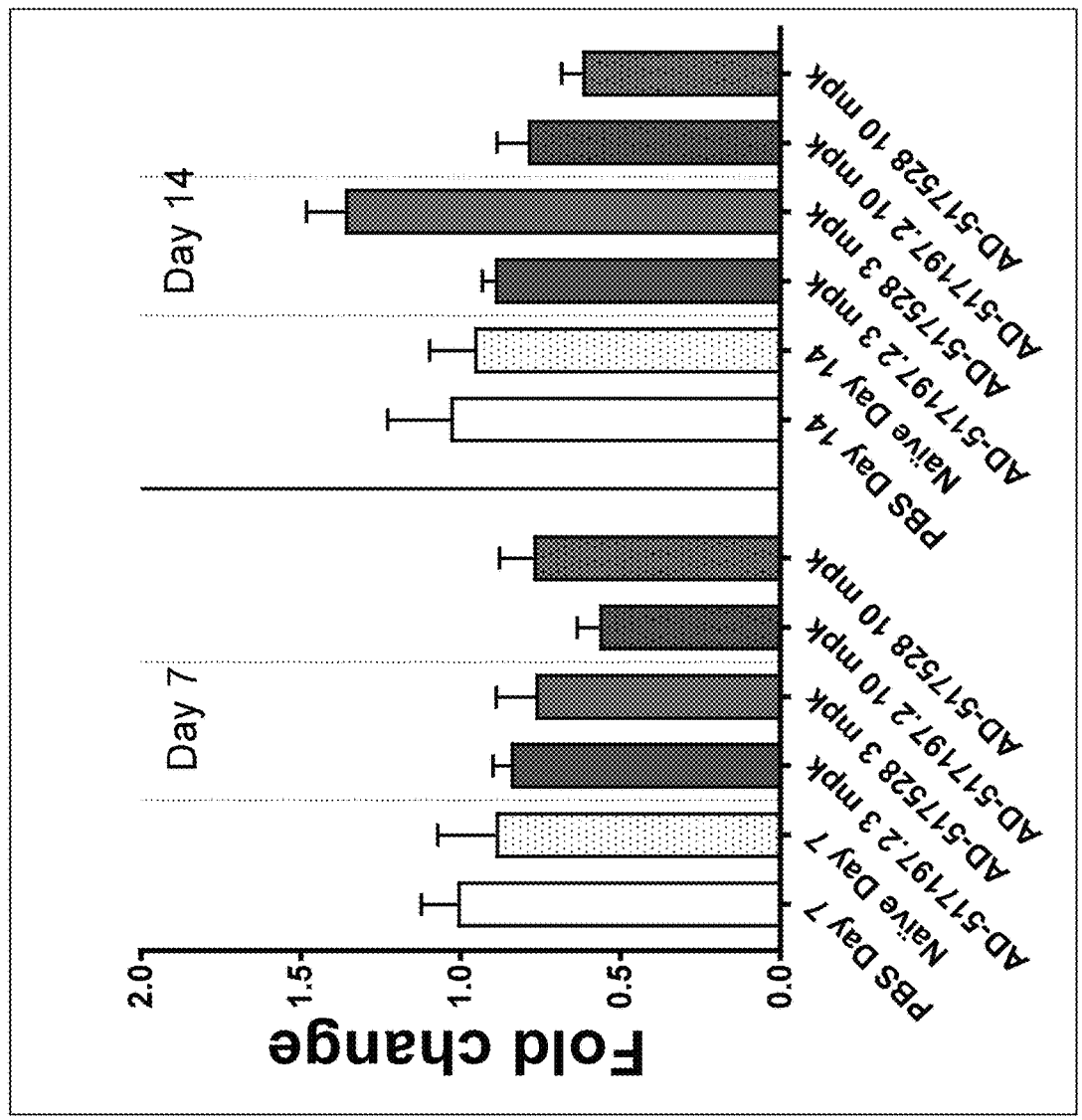
FIG. 1 is a graph showing human PNPLA3 mRNA levels in mice (n=3 per group) subcutaneously administered a single 3 mg/kg or 10 mg/kg dose of the indicated dsRNA duplexes, on day 7 or day 14 post-dose. Human PNPLA3 mRNA levels are shown relative to control levels detected with PBS treatment.

The present invention provides iRNA compositions which effect the RNA-induced silencing complex (RISC)-mediated cleavage of RNA transcripts of a Patatin-Like Phospholipase Domain Containing 3 (PNPLA3) gene. The gene may be within a cell, e.g., a cell within a subject, such as a human. The use of these iRNAs enables the targeted degradation of mRNAs of the corresponding gene (Patatin-Like Phospholipase Domain Containing 3 (PNPLA3) gene) in mammals.

The iRNAs of the invention have been designed to target the human Patatin-Like Phospholipase Domain Containing 3 (PNPLA3) gene, including portions of the gene that are conserved in the Patatin-Like Phospholipase Domain Containing 3 (PNPLA3) orthologs of other mammalian species. Without intending to be limited by theory, it is believed that a combination or sub-combination of the foregoing properties and the specific target sites or the specific modifications in these iRNAs confer to the iRNAs of the invention improved efficacy, stability, potency, durability, and safety.

Accordingly, the present invention provides methods for treating and preventing an Patatin-Like Phospholipase Domain Containing 3 (PNPLA3)-associated disorder, e.g., fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD), using iRNA compositions which effect the RNA-induced silencing complex (RISC)-mediated cleavage of RNA transcripts of a PNPLA3 gene.

The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an PNPLA3 gene.

In certain embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of an PNPLA3 gene. In some embodiments, such iRNA agents having longer length antisense strands preferably may include a second RNA strand (the sense strand) of 20-60 nucleotides in length wherein the sense and antisense strands form a duplex of 18-30 contiguous nucleotides.

The use of iRNAs of the invention enables the targeted degradation of mRNAs of the corresponding gene (PNPLA3 gene) in mammals. Using in vitro assays, the present inventors have demonstrated that iRNAs targeting a PNPLA3 gene can potently mediate RNAi, resulting in significant inhibition of expression of a PNPLA3 gene. Thus, methods and compositions including these iRNAs are useful for treating a subject having a PNPLA3-associated disorder, e.g., fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD).

Accordingly, the present invention provides methods and combination therapies for treating a subject having a disorder that would benefit from inhibiting or reducing the expression of an PNPLA3 gene, e.g., a Patatin-Like Phospholipase Domain Containing 3 (PNPLA3)-associated disease, such as fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD), using iRNA compositions which effect the RNA-induced silencing complex (RISC)-mediated cleavage of RNA transcripts of an PNPLA3 gene.

The present invention also provides methods for preventing at least one symptom in a subject having a disorder that would benefit from inhibiting or reducing the expression of a PNPLA3 gene, e.g., fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). For example, in a subject having NAFLLD, the methods of the present invention may reduce at least one symptom in the subject, e.g., fatigue, weakness, weight loss, loss of appetite, nausea, abdominal pain, spider-like blood vessels, yellowing of the skin and eyes (jaundice), itching, fluid build up and swelling of the legs (edema), abdomen swelling (ascites), and mental confusion.

The following detailed description discloses how to make and use compositions containing iRNAs to inhibit the expression of a PNPLA3 gene as well as compositions, uses, and methods for treating subjects that would benefit from inhibition and/or reduction of the expression of a PNPLA3 gene, e.g., subjects susceptible to or diagnosed with a PNPLA3-associated disorder.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a sequence and its indicated site on a transcript or other sequence, the nucleotide sequence recited in the specification takes precedence.

As used herein, "Patatin-Like Phospholipase Domain Containing 3," used interchangeably with the term "PNPLA3," refers to the well-known gene that encodes a triacylglycerol lipase that mediates triacyl glycerol hydrolysis in adipocytes.

Exemplary nucleotide and amino acid sequences of PNPLA3 can be found, for example, at GenBank Accession No. NM_025225.2 (*Homo sapiens* PNPLA3; SEQ ID NO:1; reverse complement, SEQ ID NO:2); GenBank Accession No. NM_054088.3 (*Mus musculus* PNPLA3; SEQ ID NO:3; reverse complement, SEQ ID NO:4); GenBank Accession No. NM_001282324.1 (*Rattus norvegicus* PNPLA3; SEQ ID NO:5; reverse complement, SEQ ID NO:6); GenBank Accession No. XM_005567051.1 (*Macaca fascicularis* PNPLA3, SEQ ID NO:7; reverse complement, SEQ ID NO:8); GenBank Accession No. XM_001109144.2 (*Macaca mulatta* PNPLA3, SEQ ID NO:9; reverse complement, SEQ ID NO:10); and GenBank Accession No. XM_005567052.1 (*Macaca fascicularis* PNPLA3, SEQ ID NO:11; reverse complement, SEQ ID NO:12).

Additional examples of PNPLA3 mRNA sequences are readily available through publicly available databases, e.g., GenBank, UniProt, OMIM, and the *Macaca* genome project web site.

Further information on PNPLA3 can be found, for example, at www.ncbi.nlm.nih.gov/gene/?term=pnpla3.

The entire contents of each of the foregoing GenBank Accession numbers and the Gene database numbers are incorporated herein by reference as of the date of filing this application.

The term PNPLA3, as used herein, also refers to variations of the PNPLA3 gene including variants provided in the SNP database. Numerous sequence variations within the PNPLA3 gene have been identified and may be found at, for example, NCBI dbSNP and UniProt (see, e.g., www.ncbi.nlm.nih.gov/snp/?term=pnpla3, the entire contents of which is incorporated herein by reference as of the date of filing this application.

As used herein, "target sequence" refers to a contiguous portion of the nucleotide sequence of an mRNA molecule formed during the transcription of a PNPLA3 gene, including mRNA that is a product of RNA processing of a primary transcription product. The target portion of the sequence will be at least long enough to serve as a substrate for iRNA-directed cleavage at or near that portion of the nucleotide sequence of an mRNA molecule formed during the transcription of a PNPLA3 gene. In one embodiment, the target sequence is within the protein coding region of PNPLA3.

The target sequence may be from about 19-36 nucleotides in length, e.g., preferably about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In certain embodiments, the target sequence is 19-23 nucleotides in length, optionally 21-23 nucleotides in length. Ranges and lengths intermediate to the above recited ranges and lengths are also contemplated to be part of the disclosure.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a PNPLA3 gene in a cell, e.g., a cell within a subject, such as a mammalian subject.

In one embodiment, an RNAi agent of the invention includes a single stranded RNA that interacts with a target RNA sequence, e.g., a PNPLA3 target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., a PNPLA3 gene. Accordingly, the term "siRNA" is also used herein to refer to an iRNA as described above.

In certain embodiments, the RNAi agent may be a single-stranded siRNA (ssRNAi) that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In certain embodiments, an "iRNA" for use in the compositions, uses, and methods of the invention is a double stranded RNA and is referred to herein as a "double stranded RNA agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a PNPLA3 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide or a modified nucleotide. In addition, as used in this specification, an "iRNA" may include ribonucleotides with chemical modifications; an iRNA may include substantial modifications at multiple nucleotides. As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

In certain embodiments of the instant disclosure, inclusion of a deoxy-nucleotide if present within an RNAi agent can be considered to constitute a modified nucleotide.

The duplex region may be of any length that permits specific degradation of a desired target RNA through a RISC pathway, and may range from about 19 to 36 base pairs in length, e.g., about 19-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, 3, 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not be, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, an iRNA agent of the invention is a dsRNA, each strand of which comprises 19-23 nucleotides, that interacts with a target RNA sequence, e.g., a PNPLA3 gene, to direct cleavage of the target RNA.

In some embodiments, an iRNA of the invention is a dsRNA of 24-30 nucleotides that interacts with a target RNA sequence, e.g., a PNPLA3 target mRNA sequence, to direct the cleavage of the target RNA.

As used herein, the term "nucleotide overhang" refers to at least one unpaired nucleotide that protrudes from the duplex structure of a double stranded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotides, e.g., a 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, 10-25 nucleotides, 10-20 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the extended overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNA agent, i.e., no nucleotide overhang. A "blunt ended" double stranded RNA agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end. Most often such a molecule will be double-stranded over its entire length.

The term "antisense strand" or "guide strand" refers to the strand of an iRNA, e.g., a dsRNA, which includes a region that is substantially complementary to a target sequence, e.g., a PNPLA3 mRNA.

As used herein, the term "region of complementarity" refers to the region on the antisense strand that is substantially complementary to a sequence, for example a target sequence, e.g., a PNPLA3 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(es) is not in the seed region.

Thus, an RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of a PNPLA3 gene, generally does not contain any mismatch within the central 13 nucleotides. The methods described herein or methods known in the art can be used to determine whether an RNAi agent containing a mismatch to a target sequence is effective in inhibiting the expression of a PNPLA3 gene. Consideration of the efficacy of RNAi agents with mismatches in inhibiting expression of a PNPLA3 gene is important, especially if the particular region of complementarity in a PNPLA3 gene is known to have polymorphic sequence variation within the population.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of a double stranded RNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a PNPLA3 gene). For example, a polynucleotide is complementary to at least a part of a PNPLA3 mRNA if the sequence is substantially complementary to a non-interrupted portion of an mRNA encoding a PNPLA3 gene.

Accordingly, in some embodiments, the antisense polynucleotides disclosed herein are fully complementary to the target PNPLA3 sequence. In other embodiments, the antisense polynucleotides disclosed herein are substantially complementary to the target PNPLA3 sequence and comprise a contiguous nucleotide sequence which is at least 80% complementary over its entire length to the equivalent region of the nucleotide sequence of any one of SEQ ID NOs:1, 3, 5, 7, 9, or 11, or a fragment of any one of SEQ ID NOs:1, 3, 5, 7, 9, or 11, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target PNPLA3 sequence and comprise a contiguous nucleotide sequence which is at least 80% complementary over its entire length to a fragment of SEQ ID NO: 1 selected from the group of nucleotides 677-721; 683-721; 773-817; 1185-1295; 1185-1241; 1202-1295; 1202-1241; 1255-1295; 1738-1792; 1901-1945; 1920-1945; 2108-2208; 2108-2166; 2108-2136, 2121-2166; 2121-2208; 2169-2208; 2176-2208; or 2239-2265 of SEQ ID NO: 1, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target PNPLA3 sequence and comprise a contiguous nucleotide sequence which is at least 80% complementary over its entire length to a fragment of SEQ ID NO: 1 selected from the group of nucleotides 574-596; 677-699; 683-705; 699-721; 773-795; 795-817; 1185-1207; 1192-1214; 1202-1224; 1208-1230; 1209-1231; 1210-1232; 1211-1233; 1212-1234; 1213-1233; 1214-1234; 1214-1236; 1215-1237; 1216-1238; 1219-1237; 1219-1241; 1255-1275; 1256-1276; 1257-1275; 1257-1277; 1258-1278; 1259-1279; 1260-1278; 1260-1280; 1261-1281; 1262-1282; 1263-1283; 1264-1282; 1264-1284; 1265-1285; 1267-1285; 1266-1286; 1266-1288; 1267-1285; 1267-1287; 1268-1290; 1269-1289; 1270-1290; 1271-1291; 1272-1292; 1273-1293; 1274-1294; 1275-1295; 1631-1653; 1738-1760; 1739-1761; 1740-1760; 1740-1762; 1741-1763; 1744-1766; 1746-1766; 1750-1772; 1751-1773; 1752-1774; 1753-1775; 1754-1776; 1755-1777; 1756-1778; 1757-1779; 1758-1780; 1759-1781; 1760-1782; 1761-1783; 1762-1782; 1762-1784; 1763-1785; 1764-1786; 1765-1787; 1766-1786; 1766-1788; 1767-1787; 1768-1788; 1767-1789; 1769-1789; 1770-1788; 1770-1790; 1771-1791; 1772-1792; 1815-1837; 1901-1923, 1920-1942, 1923-1945; 2112-2130; 2169-2191; 2171-2191; 2176-2198, 2177-2199, 2178-2200; 2179-2201, 2180-2202; 2181-2203; 2183-2205; 2184-2206; 2186-2208; 2239-2261; 2241-2263; 2242-2264; or 2243-2265 of SEQ ID NO: 1, such as about 85%, about 90%, about 91%, about 92%, about 93%, about 94%, about 95%, about 96%, about 97%, about 98%, or about 99% complementary.

In other embodiments, the antisense polynucleotides disclosed herein are substantially complementary to the target PNPLA3 sequence and comprise a contiguous nucleotide sequence which is at least about 80% complementary over its entire length to any one of the sense strand nucleotide sequences in any one of any one of Tables 2-11, 21, 24, 27, 30, 32, 33, 36, 37, 49 or 50, or a fragment of any one of the sense strand nucleotide sequences in any one of Tables 2-11, 21, 24, 27, 30, 32, 33, 36, 37, 49 or 50, such as about 85%, about 90%, about 91%, about 92%, about 93%, about 94%, about 95%, about 96%, about 97%, about 98%, about 99%, or 100% complementary.

In one embodiment, an RNAi agent of the disclosure includes a sense strand that is substantially complementary to an antisense polynucleotide which, in turn, is the same as a target PNPLA3 sequence, and wherein the sense strand polynucleotide comprises a contiguous nucleotide sequence which is at least about 80% complementary over its entire length to the equivalent region of the nucleotide sequence of SEQ ID NOs: 2, 4, 6, 8, 10, or 12, or a fragment of any one of SEQ ID NOs:2, 4, 6, 8, 10, or 12, such as about 85%, about 90%, about 91%, about 92%, about 93%, about 94%, about 95%, about 96%, about 97%, about 98%, about 99%, or 100% complementary.

In some embodiments, an iRNA of the invention includes a sense strand that is substantially complementary to an antisense polynucleotide which, in turn, is complementary to a target PNPLA3 sequence, and wherein the sense strand polynucleotide comprises a contiguous nucleotide sequence which is at least about 80% complementary over its entire length to any one of the antisense strand nucleotide sequences in any one of any one of Tables 2-11, 21, 24, 27, 30, 32, 33, 36, 37, 49 or 50, or a fragment of any one of the antisense strand nucleotide sequences in any one of Tables 2-11, 21, 24, 27, 30, 32, 33, 36, 37, 49 or 50, such as about 85%, about 90%, about 91%, about 92%, about 93%, about 94%, about 95%, about 96%, about 97%, about 98%, about 99%, or 100% complementary.

In certain embodiments, the sense and antisense strands are selected from any one of duplexes AD-517197.2; AD-517258.2; AD-516748.2; AD-516851.2; AD-519351.2; AD-519754.2; AD-519828.2; AD-520018.2; AD-520035.2; AD-520062.2; AD-520064.2; AD-520065.2; AD-520067.2; AD-75289.2; AD-520069.2; AD-520099.2; AD-67575.7; AD-520101.2; AD-67605.7, AD-1193323.1; AD-1193344.1; AD-1193350.1; AD-1193365.1; AD-1193379.1; AD-1193407.1; AD-1193421.1; AD-1193422.1; AD-1193429.1; AD-1193437.1; AD-1193443.1; AD-1193471.1; and AD-1193481.1 In some embodiments, the sense and antisense strands are selected from any one of duplexes AD-519345.1, AD-519346.1, AD-519347.1, AD-67554.7, AD-519752.3, AD-1010731.1, AD-1010732.1, AD-519343.1, AD-519344.1, AD-519349.1, AD-519350.1, AD-519753.2, AD-519932.1, AD-519935.2, AD-520018.6, AD-517837.2, AD-805635.2, AD-519329.2, AD-520063.2, AD-519757.2, AD-805631.2, AD-516917.2, AD-516828.2, AD-518983.2, AD-805636.2, AD-519754.7, AD-520062.2, AD-67575.9, AD-518923.3, AD-520053.4, AD-519667.2, AD-519773.2, AD-519354.2, AD-520060.4, AD-520061.4, AD-1010733.2, AD-1010735.2, AD-1193323.1, AD-1193344.1; AD-1193350.1; AD-1193365.1; AD-1193379.1; AD-1193407.1; AD-1193421.1; AD-1193422.1;

AD-1193429.1; AD-1193437.1; AD-1193443.1; AD-1193471.1; and AD-1193481.1.

In some embodiments, the sense and antisense strands are from duplex AD-519351.

In general, an "iRNA" includes ribonucleotides with chemical modifications. Such modifications may include all types of modifications disclosed herein or known in the art. Any such modifications, as used in a dsRNA molecule, are encompassed by "iRNA" for the purposes of this specification and claims.

In certain embodiments of the instant disclosure, inclusion of a deoxy-nucleotide if present within an RNAi agent can be considered to constitute a modified nucleotide.

In an aspect of the invention, an agent for use in the methods and compositions of the invention is a single-stranded antisense oligonucleotide molecule that inhibits a target mRNA via an antisense inhibition mechanism. The single-stranded antisense oligonucleotide molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense oligonucleotide molecule may be about 14 to about 30 nucleotides in length and have a sequence that is complementary to a target sequence. For example, the single-stranded antisense oligonucleotide molecule may comprise a sequence that is at least about 14, 15, 16, 17, 18, 19, 20, or more contiguous nucleotides from any one of the antisense sequences described herein.

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a horse, a goat, a rabbit, a sheep, a hamster, a guinea pig, a cat, a dog, a rat, or a mouse), or a bird that expresses the target gene, either endogenously or heterologously. In an embodiment, the subject is a human, such as a human being treated or assessed for a disease or disorder that would benefit from reduction in PNPLA3 expression; a human at risk for a disease or disorder that would benefit from reduction in PNPLA3 expression; a human having a disease or disorder that would benefit from reduction in PNPLA3 expression; or human being treated for a disease or disorder that would benefit from reduction in PNPLA3 expression as described herein. In some embodiments, the subject is a female human. In other embodiments, the subject is a male human. In one embodiment, the subject is an adult subject. In another embodiment, the subject is a pediatric subject.

As used herein, the terms "treating" or "treatment" refer to a beneficial or desired result, such as reducing at least one sign or symptom of a PNPLA3-associated disorder in a subject. Treatment also includes a reduction of one or more sign or symptoms associated with unwanted PNPLA3 expression; diminishing the extent of unwanted PNPLA3 activation or stabilization; amelioration or palliation of unwanted PNPLA3 activation or stabilization. "Treatment" can also mean prolonging survival as compared to expected survival in the absence of treatment. The term "lower" in the context of the level of PNPLA3 in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of PNPLA3 in a subject is preferably down to a level accepted as within the range of normal for an individual without such disorder. In certain embodiments, "lower" is the decrease in the difference between the level of a marker or symptom for a subject suffering from a disease and a level accepted within the range of normal for an individual, e.g., the level of decrease in bodyweight between an obese individual and an individual having a weight accepted within the range of normal.

As used herein, "prevention" or "preventing," when used in reference to a disease, disorder or condition thereof, may be treated or ameliorated by a reduction in expression of an PNPLA3 gene, refers to a reduction in the likelihood that a subject will develop a symptom associated with such a disease, disorder, or condition, e.g., a symptom of unwanted or excessive PNPLA3 expression, such as the presence of elevated levels of proteins in the hedgehog signaling pathway, fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). The likelihood of developing, e.g., NAFLD, is reduced, for example, when an individual having one or more risk factors for NAFLD either fails to develop NAFLD or develops NAFLD with less severity relative to a population having the same risk factors and not receiving treatment as described herein. The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

As used herein, the term "Patatin-Like Phospholipase Domain Containing 3-associated disease" or "PNPLA3-associated disease," is a disease or disorder that is caused by, or associated with PNPLA3 gene expression or PNPLA3 protein production. The term "PNPLA3-associated disease" includes a disease, disorder or condition that would benefit from a decrease in PNPLA3 gene expression, replication, or protein activity. Non-limiting examples of PNPLA3-associated diseases include, for example, fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). In another embodiment, the PNPLA3-associated disease is nonalcoholic fatty liver disease (NAFLD). In another embodiment, the PNPLA3-associated disease is nonalcoholic steatohepatitis (NASH). In another embodiment, the PNPLA3-associated disease is liver cirrhosis. In another embodiment, the PNPLA3-associated disease is insulin resistance. In another embodiment, the PNPLA3-associated disease is not insulin resistance. In one embodiment, the PNPLA3-associated disease is obesity.

In one embodiment, a PNPLA3-associated disease is nonalcoholic fatty liver disease (NAFLD). As used herein, "nonalcoholic fatty liver disease," used interchangeably with the term "NAFLD," refers to a disease defined by the presence of macrovascular steatosis in the presence of less than 20 gm of alcohol ingestion per day. NAFLD is the most common liver disease in the United States, and is commonly associated with insulin resistance/type 2 diabetes mellitus and obesity. NAFLD is manifested by steatosis, steatohepatitis, cirrhosis, and sometimes hepatocellular carcinoma. For a review of NAFLD, see Tolman and Dalpiaz (2007) *Ther. Clin. Risk. Manag.*, 3(6):1153-1163 the entire contents of which are incorporated herein by reference.

"Therapeutically effective amount," as used herein, is intended to include the amount of an RNAi agent that, when administered to a subject having a PNPLA3-associated disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an RNAi agent that, when administered to a subject having a PNPLA3-associated disorder, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired effect at a reasonable benefit/risk ratio applicable to any treatment. The iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Such carriers are known in the art. Pharmaceutically acceptable carriers include carriers for administration by injection.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to urine obtained from the subject. A "sample derived from a subject" can refer to blood or blood derived serum or plasma from the subject.

II. iRNAs of the Invention

The present invention provides iRNAs which inhibit the expression of a PNPLA3 gene. In preferred embodiments, the iRNA includes double stranded ribonucleic acid (dsRNA) molecules for inhibiting the expression of an PNPLA3 gene in a cell, such as a cell within a subject, e.g., a mammal, such as a human susceptible to developing a PNPLA3-associated disorder, e.g., hypertriglyceridemia. The dsRNAi agent includes an antisense strand having a region of complementarity which is complementary to at least a part of an mRNA formed in the expression of a PNPLA3 gene. The region of complementarity is about 19-30 nucleotides in length (e.g., about 30, 29, 28, 27, 26, 25, 24, 23, 22, 21, 20, or 19 nucleotides in length). Upon contact with a cell expressing the PNPLA3 gene, the iRNA inhibits the expression of the PNPLA3 gene (e.g., a human, a primate, a non-primate, or a rat PNPLA3 gene) by at least about 50% as assayed by, for example, a PCR or branched DNA (bDNA)-based method, or by a protein-based method, such as by immunofluorescence analysis, using, for example, western blotting or flow cytometric techniques. In preferred embodiments, inhibition of expression is determined by the qPCR method provided in the examples herein with the siRNA at, e.g., a 10 nM concentration, in an appropriate organism cell line provided therein. In preferred embodiments, inhibition of expression in vivo is determined by knockdown of the human gene in a rodent expressing the human gene, e.g., a mouse or an AAV-infected mouse expressing the human target gene, e.g., when administered as single dose, e.g., at 3 mg/kg at the nadir of RNA expression.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a PNPLA3 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain preferred embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is about 19 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 19 to about 30 base pairs, e.g., about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target PNPLA3 gene expression is not generated in the target cell by cleavage of a larger dsRNA.

A dsRNA as described herein can further include one or more single-stranded nucleotide overhangs e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

In an aspect, a dsRNA of the invention includes at least two nucleotide sequences, a sense sequence and an antisense sequence. The sense strand is selected from the group of sequences provided in any one of Tables 2-11, 21, 24, 27, 30, 32, 33, 36, 37, 49 or 50, and the corresponding antisense strand of the sense strand is selected from the group of sequences of any one of Tables 2-11, 21, 24, 27, 30, 32, 33, 36, 37, 49 or 50. In this aspect, one of the two sequences is complementary to the other of the two sequences, with one of the sequences being substantially complementary to a sequence of an mRNA generated in the expression of a PNPLA3 gene. As such, in this aspect, a dsRNA will include two oligonucleotides, where one oligonucleotide is described as the sense strand in any one of Tables 2-11, 21, 24, 27, 30, 32, 33, 36, 37, 49 or 50, and the second oligonucleotide is described as the corresponding antisense strand of the sense strand in any one of Tables 2-11, 21, 24, 27, 30, 32, 33, 36, 37, 49 or 50.

In certain embodiments, the substantially complementary sequences of the dsRNA are contained on separate oligonucleotides. In other embodiments, the substantially complementary sequences of the dsRNA are contained on a single oligonucleotide.

In certain embodiments, the sense or antisense strand is selected from the sense or antisense strand of any one of duplexes AD-517197.2; AD-517258.2; AD-516748.2; AD-516851.2; AD-519351.2; AD-519754.2; AD-519828.2; AD-520018.2; AD-520035.2; AD-520062.2; AD-520064.2; AD-520065.2; AD-520067.2; AD-75289.2; AD-520069.2; AD-520099.2; AD-67575.7; AD-520101.2; AD-1193323.1; AD-1193344.1; AD-1193350.1; AD-1193365.1; AD-1193379.1; AD-1193407.1; AD-1193421.1; AD-1193422.1; AD-1193429.1; AD-1193437.1; AD-1193443.1; AD-1193471.1; AD-1193481.1 or AD-67605.7.

In some embodiments, the sense or antisense strand is selected from the sense or antisense strand of any one of duplexes AD-519345.1, AD-519346.1, AD-519347.1, AD-67554.7, AD-519752.3, AD-1010731.1, AD-1010732.1, AD-519343.1, AD-519344.1, AD-519349.1, AD-519350.1, AD-519753.2, AD-519932.1, AD-519935.2, AD-520018.6, AD-517837.2, AD-805635.2, AD-519329.2, AD-520063.2, AD-519757.2, AD-805631.2, AD-516917.2, AD-516828.2, AD-518983.2, AD-805636.2, AD-519754.7, AD-520062.2, AD-67575.9, AD-518923.3, AD-520053.4, AD-519667.2, AD-519773.2, AD-519354.2, AD-520060.4, AD-520061.4, AD-1010733.2, AD-1010735.2, AD-1193323.1, AD-1193344.1; AD-1193350.1; AD-1193365.1; AD-1193379.1; AD-1193407.1; AD-1193421.1; AD-1193422.1; AD-1193429.1; AD-1193437.1; AD-1193443.1; AD-1193471.1; or AD-1193481.1.

In some embodiments, the sense or antisense strand is selected from the sense or antisense strand of duplex AD-519351.

It will be understood that, although the sequences in, for example, Tables 3, 5, 7, 9, 11, 21, 24, 27, 30, 32, 36 and 50 are not described as modified or conjugated sequences, the RNA of the iRNA of the invention e.g., a dsRNA of the invention, may comprise any one of the sequences set forth in any one of Tables 2-11, 21, 24, 27, 30, 32, 33, 36, 37, 49 or 50 that is un-modified, un-conjugated, or modified or conjugated differently than described therein. In other words, the invention encompasses dsRNA of Tables 2-11, 21, 24, 27, 30, 32, 33, 36, 37, 49 or 50 which are un-modified, un-conjugated, modified, or conjugated, as described herein.

The skilled person is well aware that dsRNAs having a duplex structure of about 20 to 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 2-11, 21, 24, 27, 30, 32, 33, 36, 37, 49 or 50. dsRNAs described herein can include at least one strand of a length of minimally 21 nucleotides. It can be reasonably expected that shorter duplexes having any one of the sequences in any one of Tables 2-11, 21, 24, 27, 30, 32, 33, 36, 37, 49 or 50 minus only a few nucleotides on one or both ends can be similarly effective as compared to the dsRNAs described above. Hence, dsRNAs having a sequence of at least 19, 20, or more contiguous nucleotides derived from any one of the sequences of any one of Tables 2-11, 21, 24, 27, 30, 32, 33, 36, 37, 49 or 50, and differing in their ability to inhibit the expression of a PNPLA3 gene by not more than about 5, 10, 15, 20, 25, or 30% inhibition from a dsRNA comprising the full sequence, are contemplated to be within the scope of the present invention.

In addition, the RNAs provided in Tables 2-11, 21, 24, 27, 30, 32, 33, 36, 37, 49 or 50 identify a site(s) in a PNPLA3 transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 19 contiguous nucleotides from any one of the sequences provided in any one of Tables 2-11, 21, 24, 27, 30, 32, 33, 36, 37, 49 or 50 coupled to additional nucleotide sequences taken from the region contiguous to the selected sequence in a PNPLA3 gene.

III. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Representative U.S. Patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. Patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science,* 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxy-thymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. Patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) Nucleic Acids Research 33(1):439-447; Mook, O R. et al., (2007) Mol Canc Ther 6(3):833-843; Grunweller, A. et al., (2003) Nucleic Acids Research 31(12): 3185-3193).

In some embodiments, the RNA of an iRNA can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-$CH_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) Nucleic Acids Research 33(1):439-447; Mook, O R. et al., (2007) Mol Canc Ther 6(3):833-843; Grunweller, A. et al., (2003) Nucleic Acids Research 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-($CH_2$)—O-2' (LNA); 4'-($CH_2$)—S-2'; 4'-($CH_2$)$_2$—O-2' (ENA); 4'-CH($CH_3$)—O-2' (also referred to as "constrained ethyl" or "cEt") and 4'-CH($CH_2OCH_3$)—O-2' (and analogs thereof; see, e.g., U.S. Pat. No. 7,399,845); 4'-C($CH_3$)($CH_3$)—O-2' (and analogs thereof; see e.g., U.S. Pat. No. 8,278,283); 4'-$CH_2$—N($OCH_3$)-2' (and analogs thereof; see e.g., U.S. Pat. No. 8,278,425); 4'-$CH_2$—O—N($CH_3$)-2' (see, e.g., U.S. Patent Publication No. 2004/0171570); 4'-$CH_2$—N(R)—O-2', wherein R is H, C1-C12 alkyl, or a protecting group (see, e.g., U.S. Pat. No. 7,427,672); 4'-$CH_2$—C(H)($CH_3$)-2' (see, e.g., Chattopadhyaya et al., J. Org. Chem., 2009, 74, 118-134); and 4'-$CH_2$—C(=$CH_2$)-2' (and analogs thereof; see, e.g., U.S. Pat. No. 8,278,426). The entire contents of each of the foregoing are hereby incorporated herein by reference.

Additional representative U.S. Patents and U.S. Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH (CH₃)—O-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, U.S. Patent Publication No. 2013/0190383; and PCT publication WO 2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.,* 2009, 10, 1039 hereby incorporated by reference).

Representative U.S. publications that teach the preparation of UNA include, but are not limited to, U.S. Pat. No. 8,314,227; and U.S. Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example U.S. Patent Publication No. 2012/0157511, the entire contents of which are incorporated herein by reference.

A. Modified iRNAs Comprising Motifs of the Invention

In certain aspects of the invention, the double stranded RNA agents of the invention include agents with chemical modifications as disclosed, for example, in WO2013/075035, the entire contents of each of which are incorporated herein by reference. WO2013/075035 provides motifs of three identical modifications on three consecutive nucleotides into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNA agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNA agents capable of inhibiting the expression of a target gene (i.e., PNPLA3 gene) in vivo. The RNAi agent comprises a sense strand and an antisense strand. Each strand of the RNAi agent may be, for example, 17-30 nucleotides in length, 25-30 nucleotides in length, 27-30 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be, for example, the duplex region can be 27-30 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 19, 20, 21, 22, 23, 24, 25, 26, and 27 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3-end of the antisense strand. The RNAi may also have a blunt end, located at the 5'-end of the antisense strand (or the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In other embodiments, the dsRNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet other embodiments, the dsRNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif. Optionally, the dsRNAi agent further comprises a ligand (preferably GalNAc$_3$).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent preferentially results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 19-23 nucleotides in length, the cleavage site of the antisense strand is typically around the 10, 11, and 12 positions from the 5'-end. Thus the motifs of three identical modifications may occur at the 9, 10, 11 positions; the 10, 11, 12 positions; the 11, 12, 13 positions; the 12, 13, 14 positions; or the 13, 14, 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications.

Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDCDCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . NaYYYN$_b$ . . . ," where "Y" represents the modification of the motif of three identical modifications on three consecutive nucleotide, and "N$_a$" and "N$_b$" represent a modification to the nucleotide next to the motif "YYY" that is different than the modification of Y, and where N$_a$ and N$_b$ can be the same or different modifications. Alternatively, N$_a$ or N$_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5'end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxy-thymine (dT) or the nucleotide at the 3'-end of the antisense strand is deoxy-thymine (dT). For example, there is a short sequence of deoxy-thymine nucleotides, for example, two dT nucleotides on the 3'-end of the sense, antisense strand, or both strands.

In certain embodiments, the sense strand sequence may be represented by formula (I):

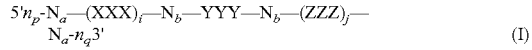

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;
wherein Nb and Y do not have the same modification; and XXX, YYY, and ZZZ each independently represent one motif of three identical modifications on three consecutive nucleotides. Preferably YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

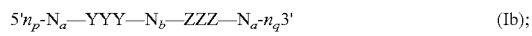  (Ib);

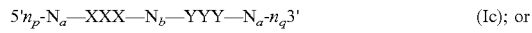  (Ic); or

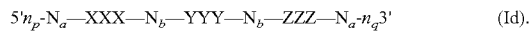  (Id).

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. Preferably, $N_b$ is 0, 1, 2, 3, 4, 5, or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

  (Ia).

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

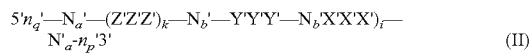  (II)

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;
wherein $N_b'$ and Y' do not have the same modification; and X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. Preferably, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

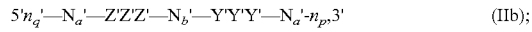  (IIb);

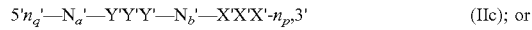  (IIc); or

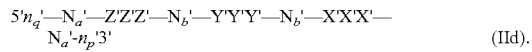  (IId).

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5, or 6.

In other embodiments, k is 0 and l is 0 and the antisense strand may be represented by the formula:

  (Ia).

When the antisense strand is represented as formula (IIa), each $N_a'$ independently represents an oligonucleotide sequence comprising 2-20, 2-15, or 2-10 modified nucleotides. Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

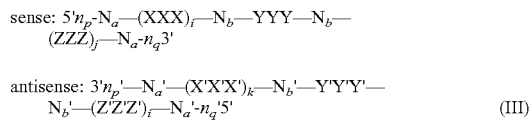  (III)

wherein:
i, j, k, and l are each independently 0 or 1;
p, p', q, and q' are each independently 0-6;
each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;
wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an iRNA duplex include the formulas below:

  (IIIa)

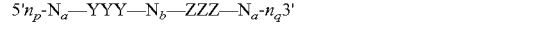

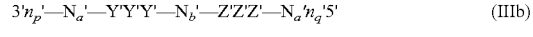  (IIIb)

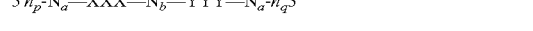

  (IIIc)

$5'n_p\text{-}N_a\text{—}XXX\text{—}N_b\text{—}YYY\text{—}N_b\text{—}ZZZ\text{—}N_a\text{-}n_q3'$ $3'n_p'\text{—}N_a'\text{—}X'X'X'\text{—}N_b'\text{—}Y'Y'Y'\text{—}N_b'\text{—}Z'Z'Z'\text{—}N_a'\text{-}n_q'5'$  (IIId)

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the dsRNAi agent is represented as formula (IIIc), each $N_b$, $N_b'$ independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b'$ independently represents an oligonucleotide sequence comprising 0-10, 0-7, 0-10, 0-7, 0-5, 0-4, 0-2, or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$, and $N_b'$ independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the $N_a$ modifications are 2'-O-methyl or 2'-fluoro modifications. In other embodiments, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

In certain embodiments, the compositions and methods of the disclosure include a vinyl phosphonate (VP) modification of an RNAi agent as described herein. In exemplary embodiments, a vinyl phosphonate of the disclosure has the following structure:

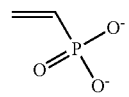

A vinyl phosphonate of the instant disclosure may be attached to either the antisense or the sense strand of a dsRNA of the disclosure. In certain preferred embodiments, a vinyl phosphonate of the instant disclosure is attached to the antisense strand of a dsRNA, optionally at the 5' end of the antisense strand of the dsRNA.

Vinyl phosphate modifications are also contemplated for the compositions and methods of the instant disclosure. An exemplary vinyl phosphate structure is:

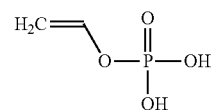

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of a iRNA can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin; preferably, the acyclic group is a serinol backbone or diethanolamine backbone.

i. Thermally Destabilizing Modifications

In certain embodiments, a dsRNA molecule can be optimized for RNA interference by incorporating thermally destabilizing modifications in the seed region of the antisense strand (i.e., at positions 2-9 of the 5'-end of the antisense strand) to reduce or inhibit off-target gene silencing. It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, or preferably positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. The term "thermally destabilizing modification(s)" includes modification(s) that would result with a dsRNA with a lower overall melting temperature (Tm) (preferably a Tm with one, two, three or four degrees lower than the Tm of the dsRNA without having such modification(s)). In some embodiments, the thermally destabilizing modification of the duplex is located at position 2, 3, 4, 5 or 9 from the 5'-end of the antisense strand.

An iRNA agent comprises a sense strand and an antisense strand, each strand having 14 to 40 nucleotides. The RNAi agent may be represented by formula (L):

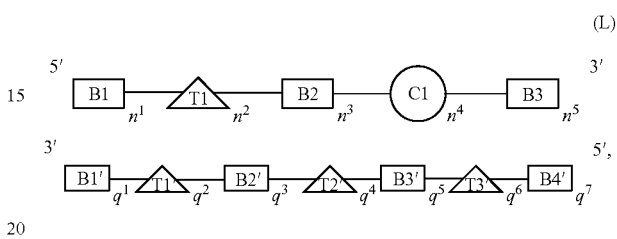

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O—N-methylacetamido (2'-O-NMA) modification.

C1 is a thermally destabilizing nucleotide placed at a site opposite to the seed region of the antisense strand (i.e., at positions 2-8 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In one embodiment, C1 has thermally destabilizing modification selected from the group consisting of: i) mismatch with the opposing nucleotide in the antisense strand; ii) abasic modification selected from the group consisting of:

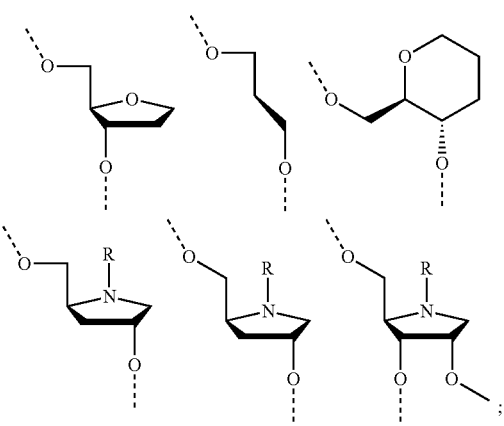

and iii) sugar modification selected from the group consisting of:

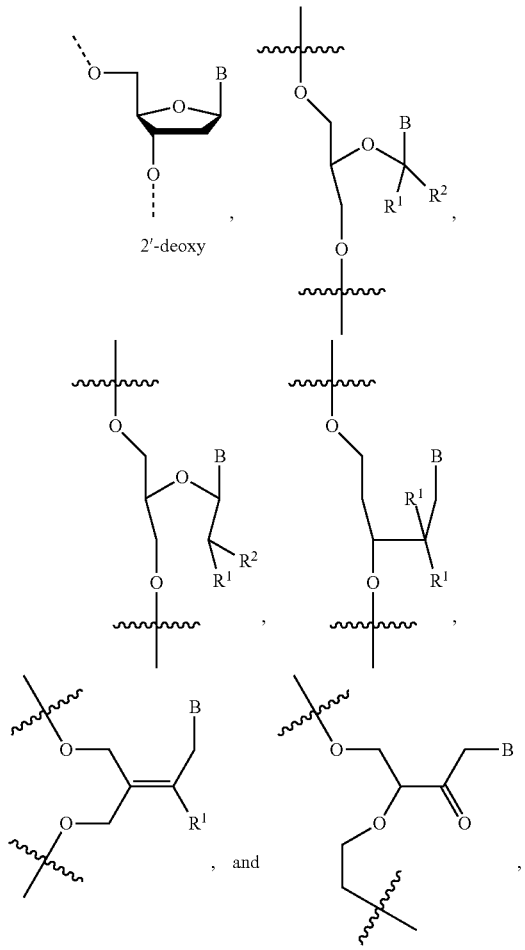

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar. In one embodiment, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxynucleobase. In one example, the thermally destabilizing modification in C1 is GNA or

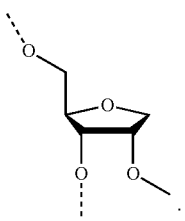

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, T1 is DNA. In one embodiment, T1' is DNA, RNA or LNA. In one embodiment, T2' is DNA or RNA. In one embodiment, T3' is DNA or RNA.

$n^1$, $n^3$, and $q^1$ are independently 4 to 15 nucleotides in length.

$n^5$, $q^3$, and $q^7$ are independently 1-6 nucleotide(s) in length.
$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length.
Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, $q^4$, and $q^6$ are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand In one embodiment, T3' starts at position 2 from the 5' end of the antisense strand. In one example, T3' is at position 2 from the 5' end of the antisense strand and $q^6$ is equal to 1.

In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In one embodiment, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1.

In one embodiment, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.
In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.
In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.
In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.
In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1.
In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-$PS_2$), 5'-end vinylphosphonate (5'-VP), 5'-end methylphosphonate (MePhos), or 5'-deoxy-5'-C-malonyl

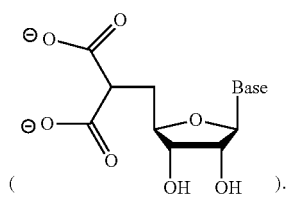

When the 5'-end phosphorus-containing group is 5'-end vinylphosphonate (5'-VP), the 5'-VP can be either 5'-E-VP isomer (i.e., trans-vinylphosphate,

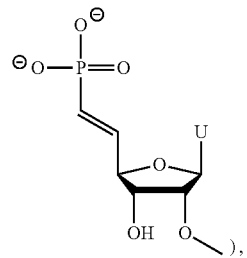

5'-Z-VP isomer (i.e., cis-vinylphosphate,

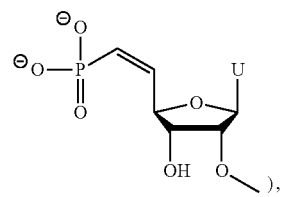

or mixtures thereof.

In one embodiment, the RNAi agent comprises a phosphorus-containing group at the 5'-end of the sense strand. In one embodiment, the RNAi agent comprises a phosphorus-containing group at the 5'-end of the antisense strand.

In one embodiment, the RNAi agent comprises a 5'-P. In one embodiment, the RNAi agent comprises a 5'-P in the antisense strand.

In one embodiment, the RNAi agent comprises a 5'-PS. In one embodiment, the RNAi agent comprises a 5'-PS in the antisense strand.

In one embodiment, the RNAi agent comprises a 5'-VP. In one embodiment, the RNAi agent comprises a 5'-VP in the antisense strand. In one embodiment, the RNAi agent comprises a 5'-E-VP in the antisense strand. In one embodiment, the RNAi agent comprises a 5'-Z-VP in the antisense strand.

In one embodiment, the RNAi agent comprises a 5'-$PS_2$. In one embodiment, the RNAi agent comprises a 5'-$PS_2$ in the antisense strand.

In one embodiment, the RNAi agent comprises a 5'-$PS_2$. In one embodiment, the RNAi agent comprises a 5'-deoxy-5'-C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNAi RNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2'

2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof), and a targeting ligand.

In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In a particular embodiment, an RNAi agent of the present invention comprises:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker; and
 (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end);
and
(b) an antisense strand having:
 (i) a length of 23 nucleotides;
 (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
 (iii) phosphorothioate internucleotide linkages between nucleotide positions 21 and 22, and between nucleotide positions 22 and 23 (counting from the 5' end);
wherein the dsRNA agents have a two nucleotide overhang at the 3'-end of the antisense strand, and a blunt end at the 5'-end of the antisense strand.

In another particular embodiment, an RNAi agent of the present invention comprises:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
 (iv) phosphorothioate internucleotide linkages between nucleotide positions 1 and 2, and between nucleotide positions 2 and 3 (counting from the 5' end);
and
(b) an antisense strand having:
 (i) a length of 23 nucleotides;
 (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 6, 8, 10, and 12 to 21, 2'-F modifications at positions 7, and 9, and a deoxy-nucleotide (e.g. dT) at position 11 (counting from the 5' end); and
 (iv) phosphorothioate internucleotide linkages between nucleotide positions 1 and 2, and between nucleotide positions 2 and 3 (counting from the 5' end);
and
(b) an antisense strand having:
 (i) a length of 23 nucleotides;
 (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 6, 8, 10, 12, 14, and 16 to 21, and 2'-F modifications at positions 7, 9, 11, 13, and 15; and
 (iv) phosphorothioate internucleotide linkages between nucleotide positions 1 and 2, and between nucleotide positions 2 and 3 (counting from the 5' end);
and
(b) an antisense strand having:
 (i) a length of 23 nucleotides;
 (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 9, and 12 to 21, and 2'-F modifications at positions 10, and 11; and
 (iv) phosphorothioate internucleotide linkages between nucleotide positions 1 and 2, and between nucleotide positions 2 and 3 (counting from the 5' end);

and
(b) an antisense strand having:
(i) a length of 23 nucleotides;
(ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-F modifications at positions 1, 3, 5, 7, 9 to 11, and 13, and 2'-OMe modifications at positions 2, 4, 6, 8, 12, and 14 to 21; and
(iv) phosphorothioate internucleotide linkages between nucleotide positions 1 and 2, and between nucleotide positions 2 and 3 (counting from the 5' end);
and
(b) an antisense strand having:
(i) a length of 23 nucleotides;
(ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
(iv) phosphorothioate internucleotide linkages between nucleotide positions 1 and 2, and between nucleotide positions 2 and 3 (counting from the 5' end);
and
(b) an antisense strand having:
(i) a length of 25 nucleotides;
(ii) 2'-OMe modifications at positions 1, 4, 6, 7, 9, 11 to 13, 15, 17, and 19 to 23, 2'-F modifications at positions 2, 3, 5, 8, 10, 14, 16, and 18, and desoxynucleotides (e.g. dT) at positions 24 and 25 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a four nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end);
and
(b) an antisense strand having:
(i) a length of 23 nucleotides;
(ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end);
and
(b) an antisense strand having:
(i) a length of 23 nucleotides;
(ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:

(a) a sense strand having:
(i) a length of 19 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 4, 6, and 10 to 19, and 2'-F modifications at positions 5, and 7 to 9; and
(iv) phosphorothioate internucleotide linkages between nucleotide positions 1 and 2, and between nucleotide positions 2 and 3 (counting from the 5' end);
and
(b) an antisense strand having:
(i) a length of 21 nucleotides;
(ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 19 and 20, and between nucleotide positions 20 and 21 (counting from the 5' end);
wherein the RNAi agents have a two nucleotide overhang at the 3'-end of the antisense strand, and a blunt end at the 5'-end of the antisense strand.

In certain embodiments, the iRNA for use in the methods of the invention is an agent selected from agents listed in any one of Tables 2-11, 21, 24, 27, 30, 32, 33, 36, 37, 49 or 50. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acid. Sci. USA*, 1989, 86: 6553-6556). In other embodiments, the ligand is cholic acid (Manoharan et al., *Biorg. Med. Chem. Let.*, 1994, 4:1053-1060), a thioether, e.g., beryl-S-tritylthiol (Manoharan et al., *Ann. N.Y. Acad. Sci.*, 1992, 660:306-309; Manoharan et al., *Biorg. Med. Chem. Let.*, 1993, 3:2765-2770), a thiocholesterol (Oberhauser et al., *Nucl. Acids Res.*, 1992, 20:533-538), an aliphatic chain, e.g., dodecandiol or undecyl residues (Saison-Behmoaras et al., *EMBO J*, 1991, 10:1111-1118; Kabanov et al., *FEBS Lett.*, 1990, 259:327-330; Svinarchuk et al., *Biochimie*, 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylaminocarbonyloxycholesterol moiety (Crooke et al., *J. Pharmacol. Exp. Ther.*, 1996, 277:923-937).

In certain embodiments, a ligand alters the distribution, targeting, or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include nonpeptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxol, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins, etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other methods for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In other embodiments, the lipid based ligand binds HSA weakly or not at all, such that the conjugate will be preferably distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 14). An RFGF analogue (e.g., amino acid sequence AALLPVLLAAP (SEQ ID NO:15) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:16) and the *Drosophila* Antennapedia protein (RQIKIWFQNRRMKWKK (SEQ ID NO:17) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.
In one embodiment, a carbohydrate conjugate for use in the compositions and methods of the invention is selected from the group consisting of:
Formula II
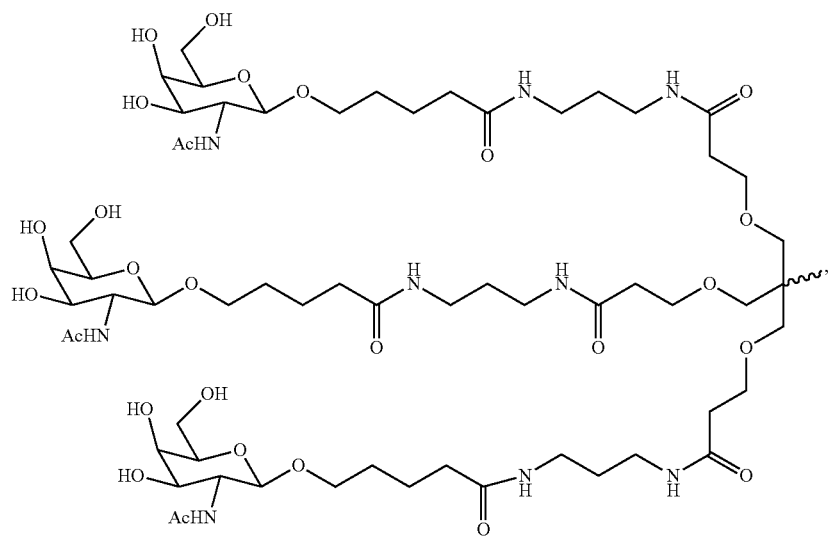
Formula III
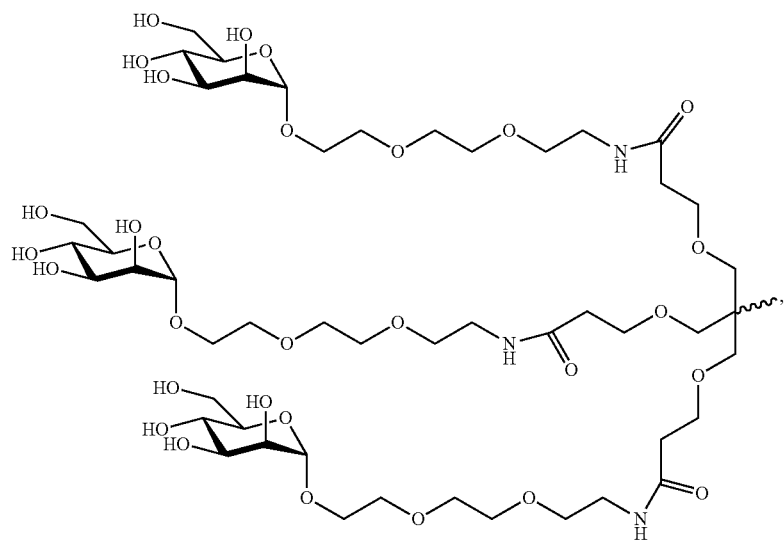
Formula IV
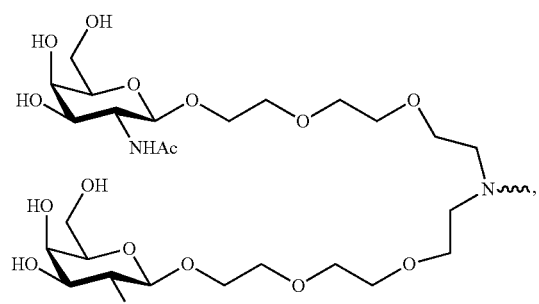
Formula V
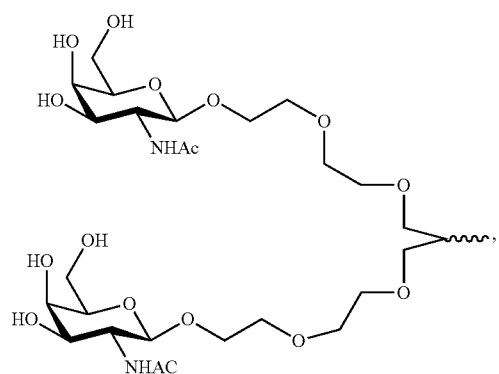

Formula VI
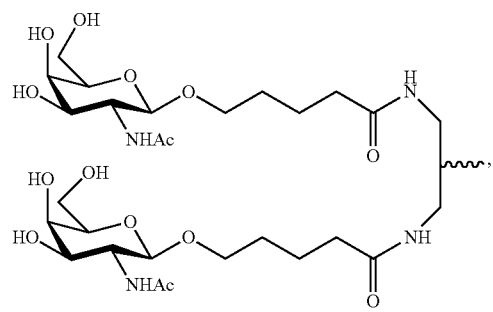
Formula VII
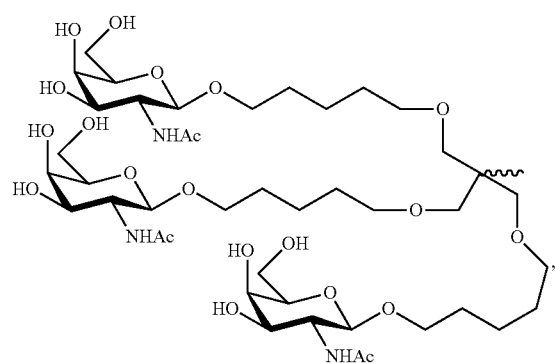
Formula VIII
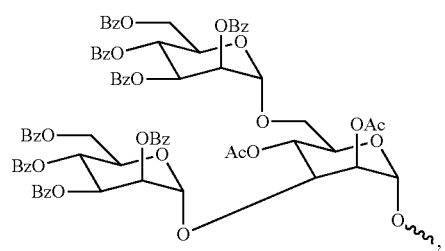
Formula IX
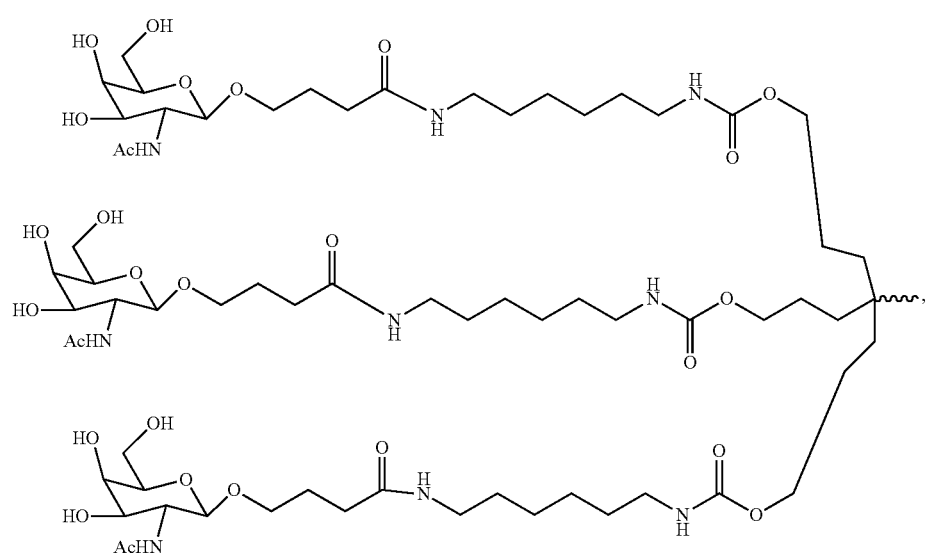

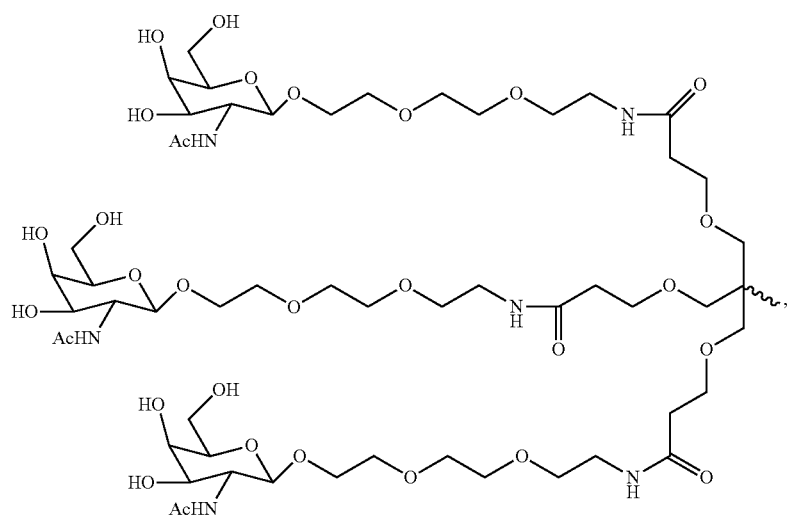
Formula X
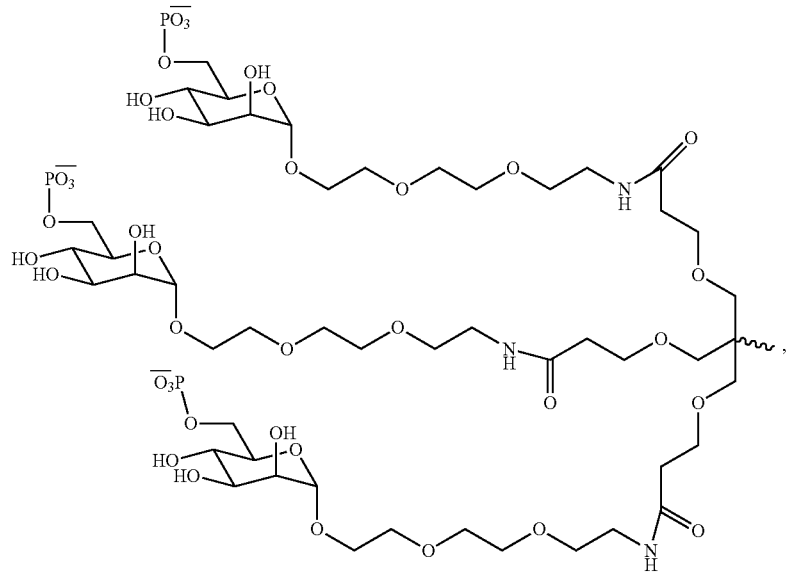
Formula XI
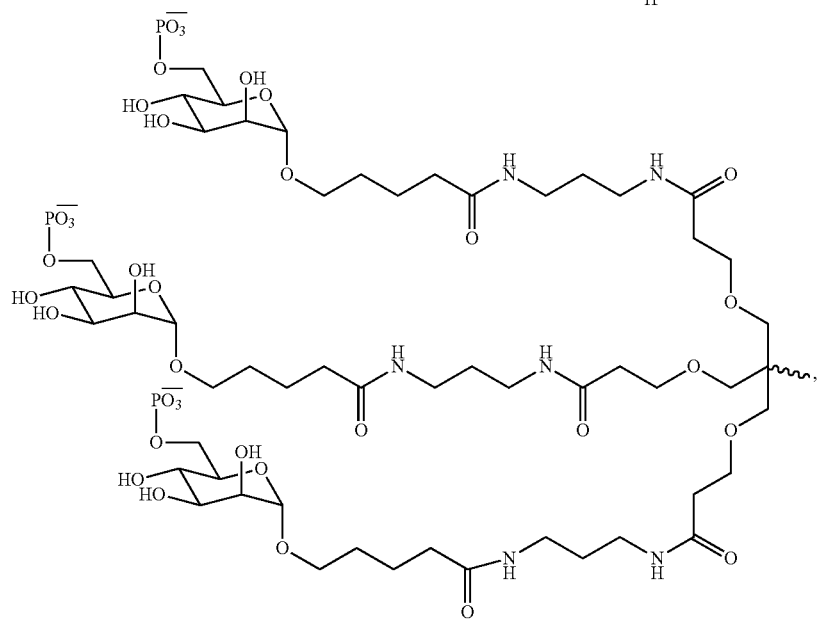
Formula XII

-continued
Formula XIII
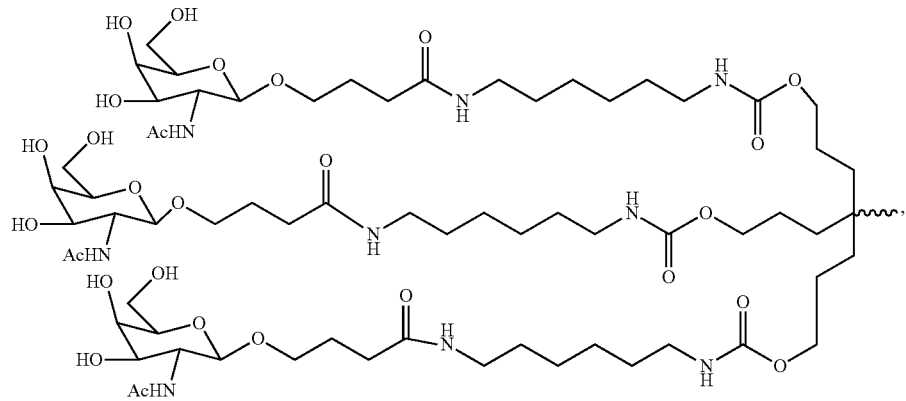
Formula XIV
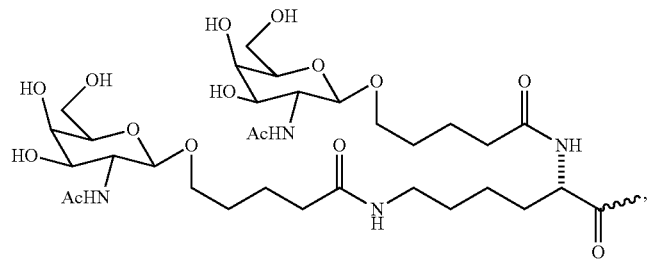
Formula XV
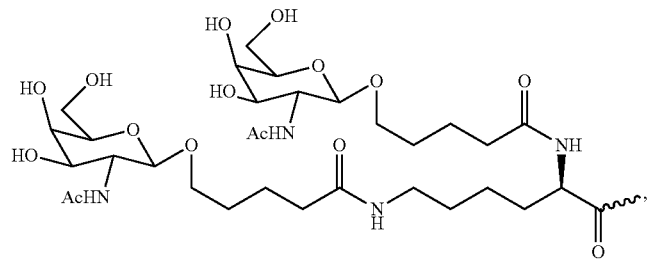
Formula XVI
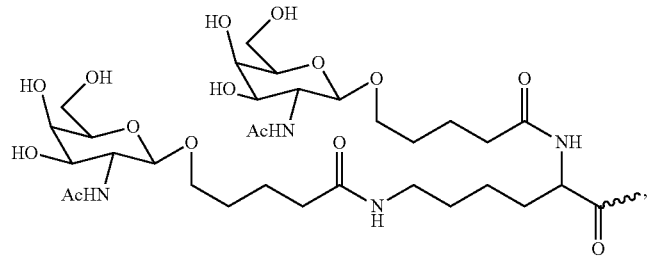
Formula XVII
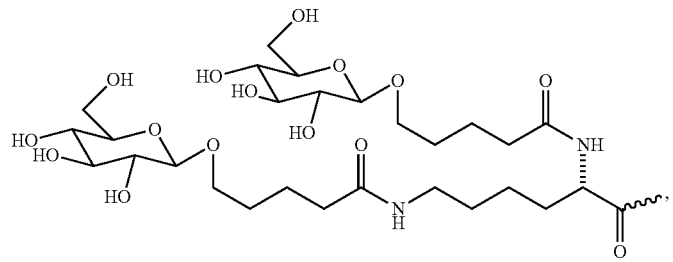

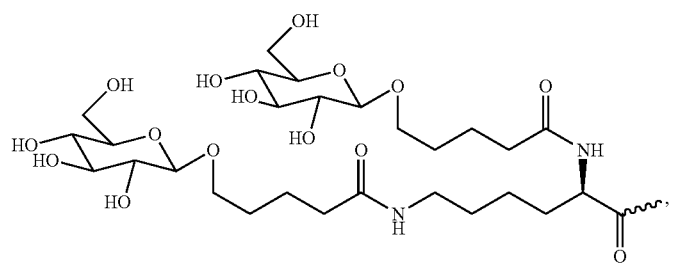
Formula XVIII
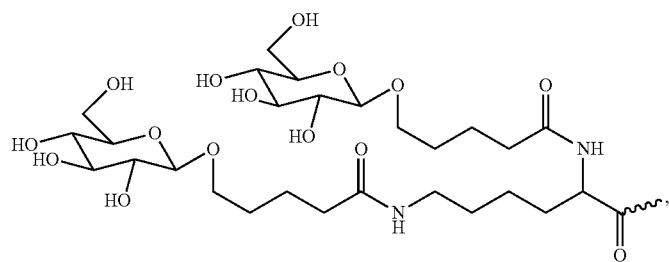
Formula XIX
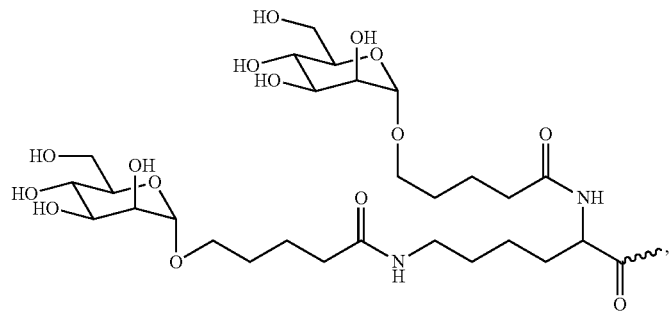
Formula XX
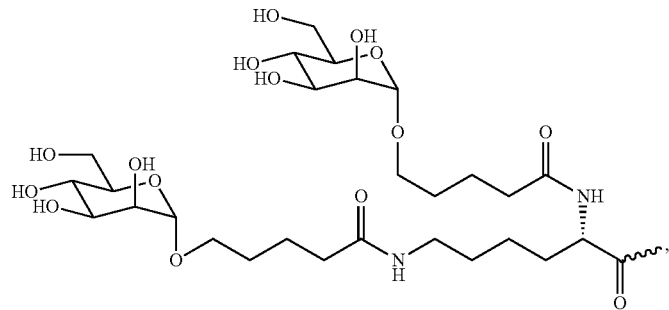
Formula XXI
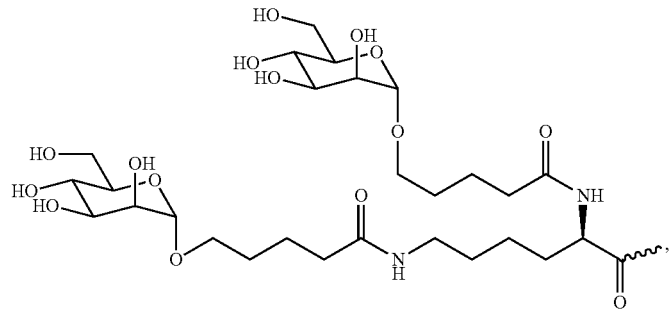
Formula XXII Formula XXIII
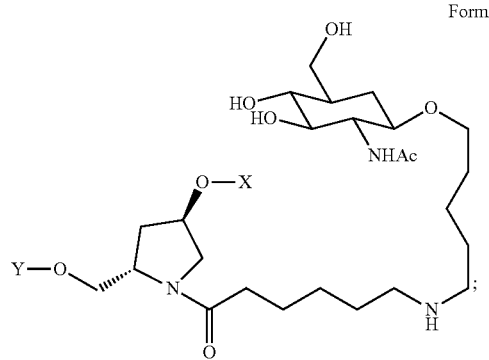
(Formula XXIV)
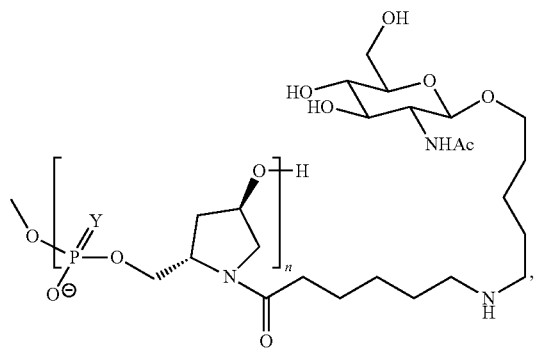
wherein Y is O or S and n is 3-6;
(Formula XXV)
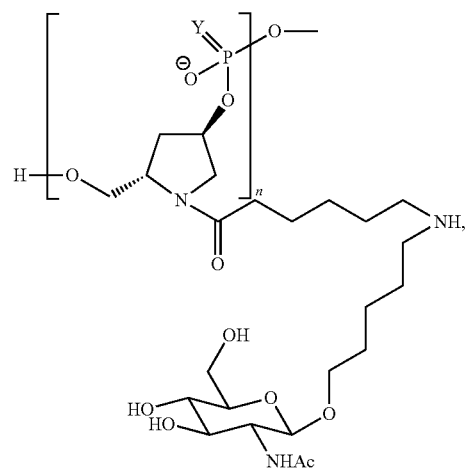
wherein Y is O or S and n is 3-6;
Formula XXVI
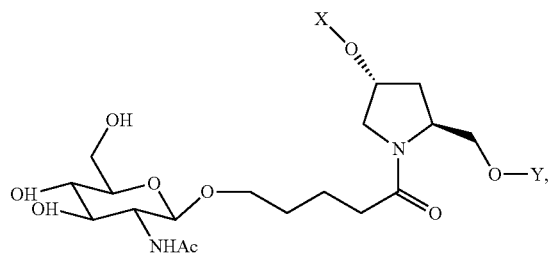
(Formula XXVII)
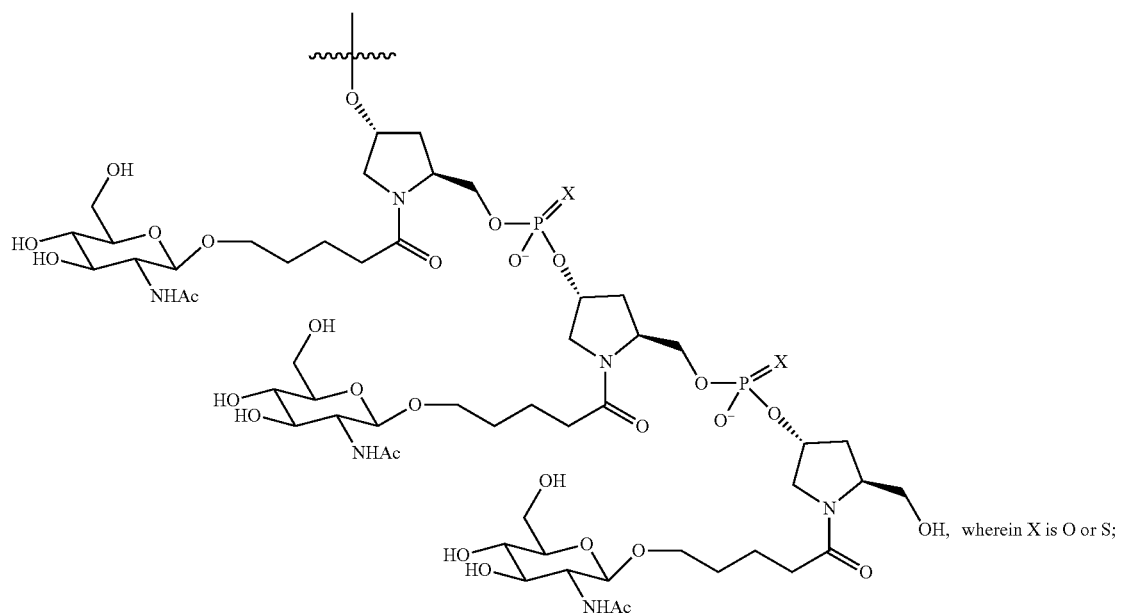
wherein X is O or S;

Formula XXVII
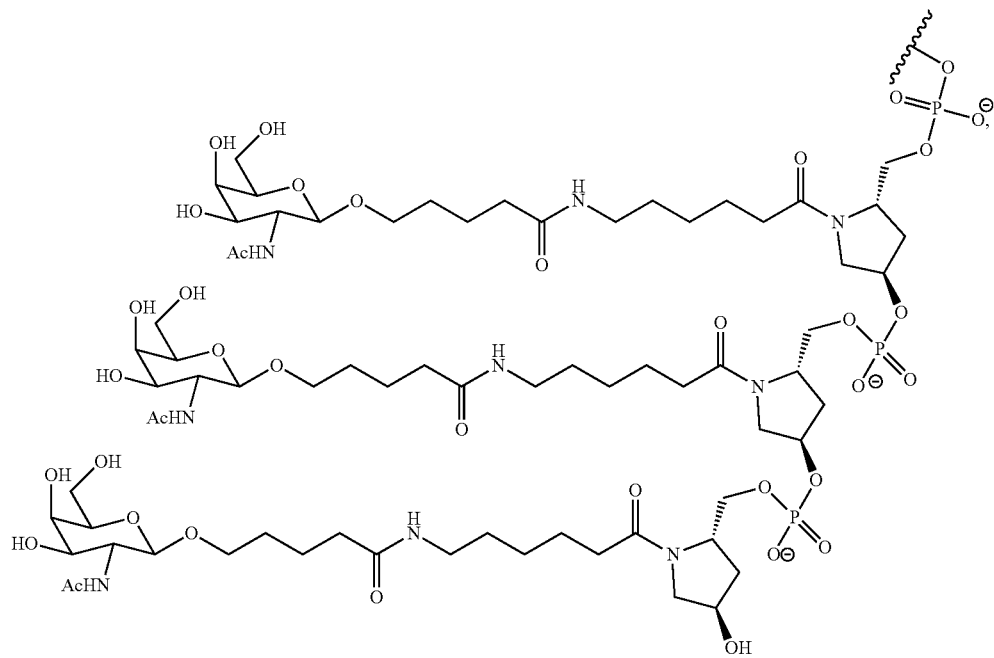
Formula XXIX
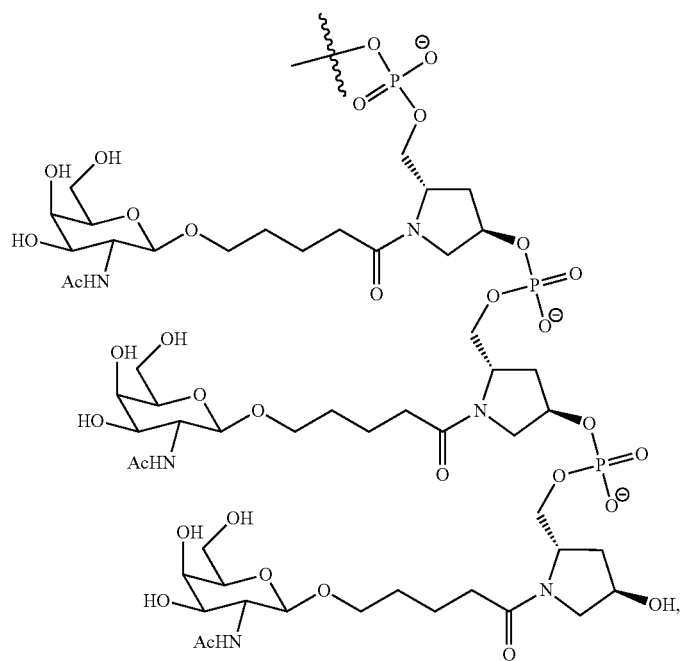

Formula XXX
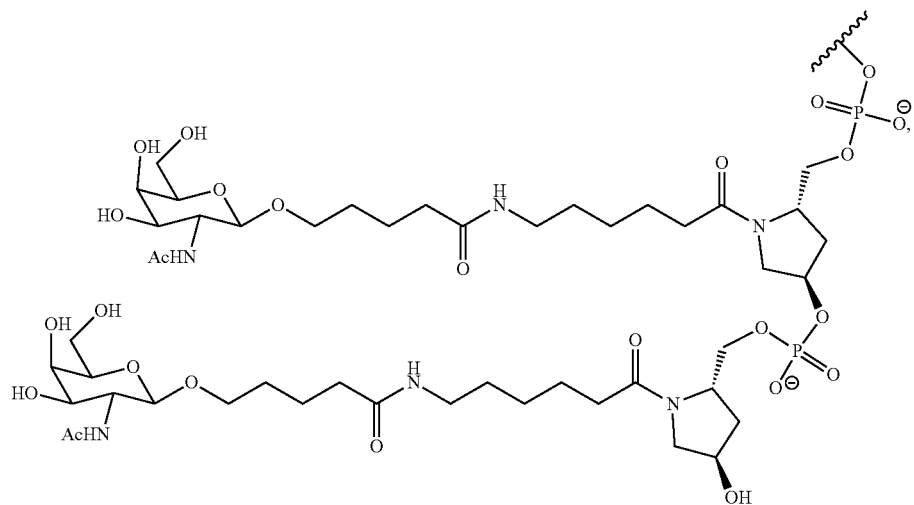
Formula XXXI
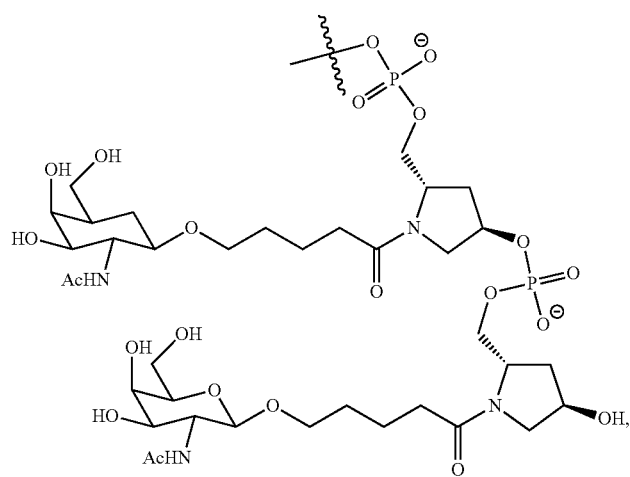
Formula XXXII
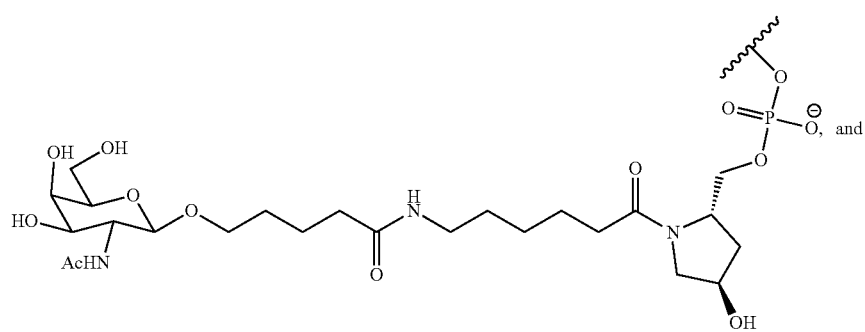

-continued
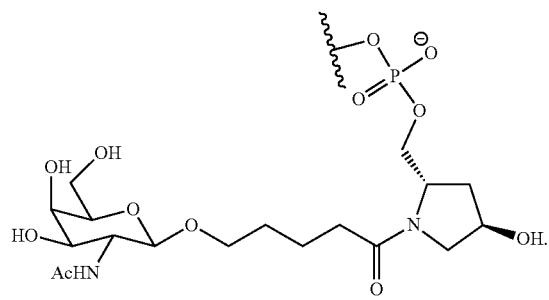
Formula XXXIII
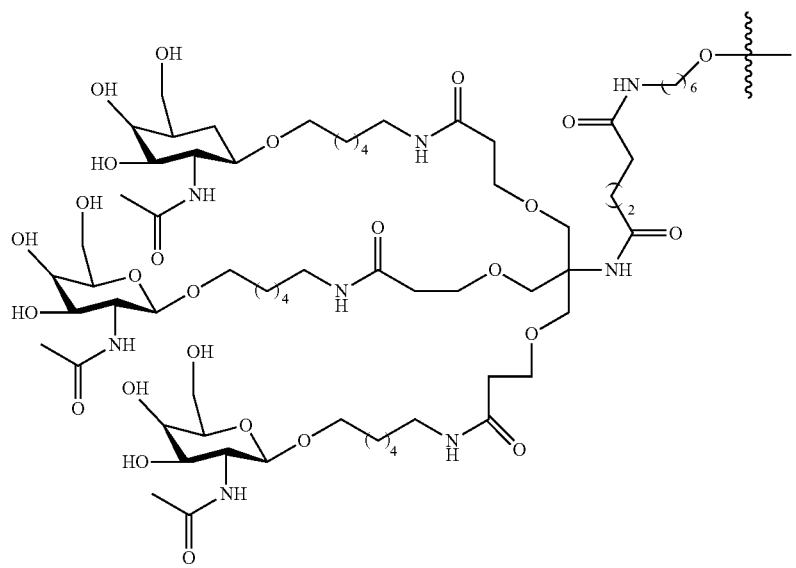
Formula XXXIV.
Formula XXXIV.
In another embodiment, a carbohydrate conjugate for use in the compositions and methods of the invention is a monosaccharide. In one embodiment, the monosaccharide is an N-acetylgalactosamine, such as
Formula II
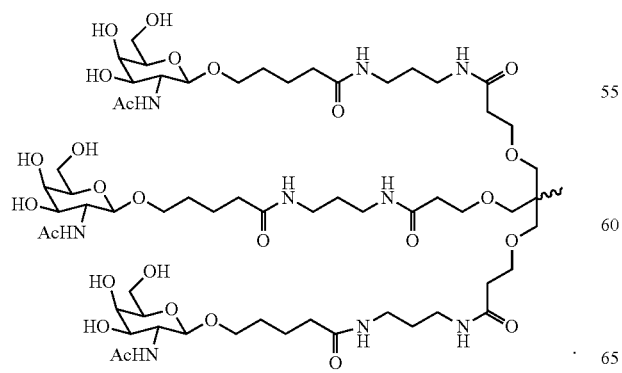

In some embodiments, the RNAi agent is attached to the carbohydrate conjugate via a linker as shown in the following schematic, wherein X is O or S
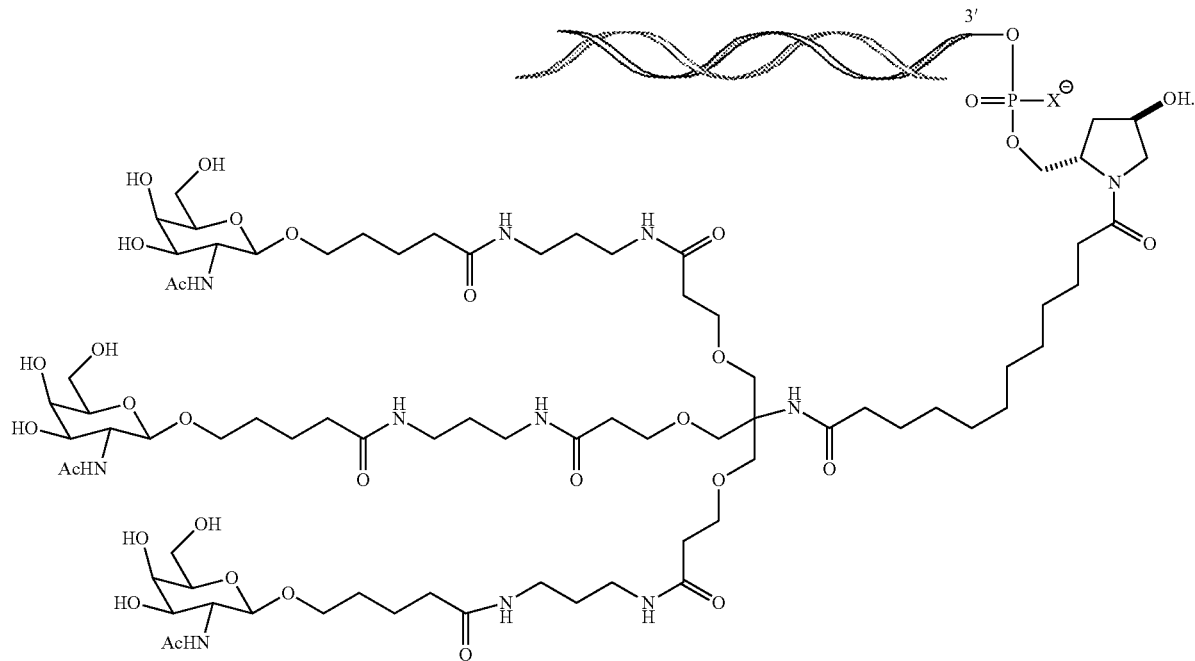
In some embodiments, the RNAi agent is conjugated to L96 as defined in Table 1 and shown below:
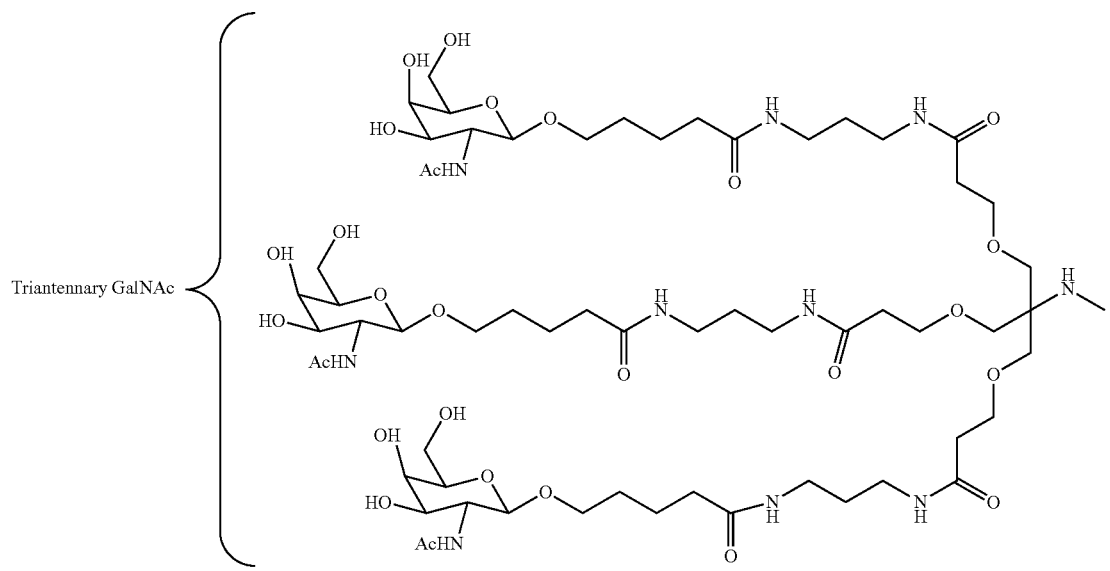

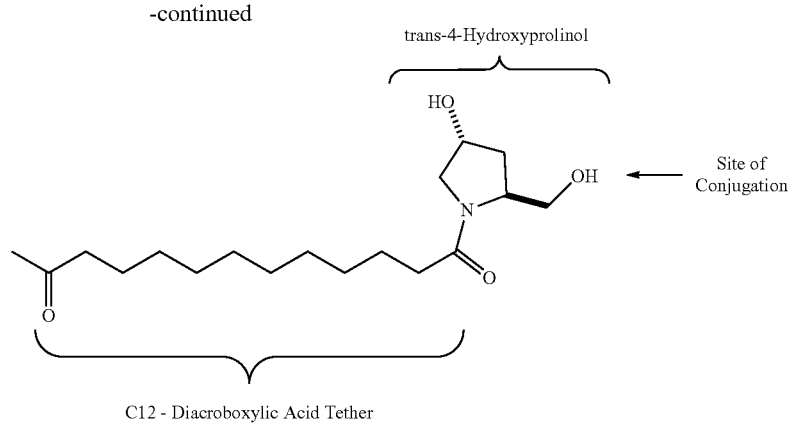
Another representative carbohydrate conjugate for use in the embodiments described herein includes, but is not limited to,
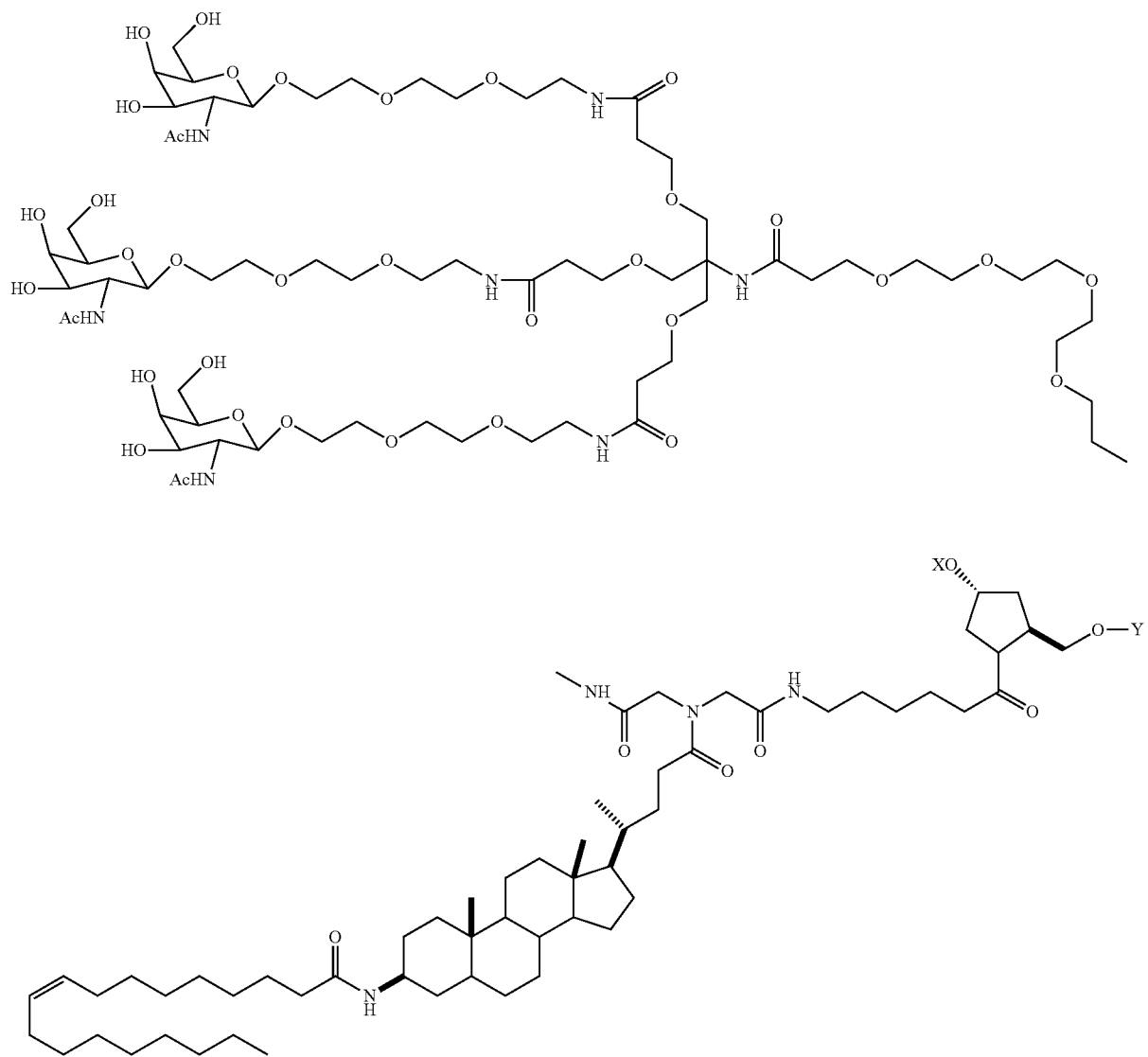

(Formula XXXVI), when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

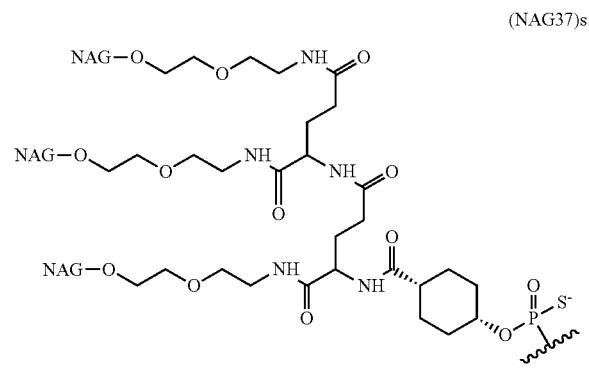

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antsisense strand. The GalNac may be attached to the 5'-end of the sense strand, the 3' end of the sense strand, the 5'-end of the antisense strand, or the 3'-end of the antisense strand. In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times, or more, or at least 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. A preferred embodiment is —O—P(O)(OH)—O—. These candidates can be evaluated using methods analogous to those described above.

iii. Acid Cleavable Linking Groups

In other embodiments, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula—NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include but are not limited to, (Formula XXXVII)

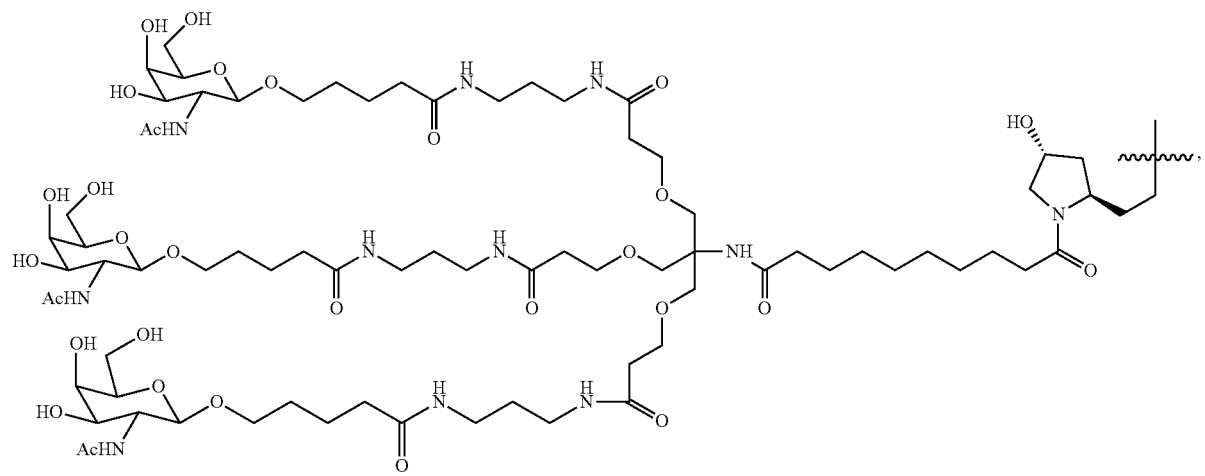

(Formula XXXVIII)

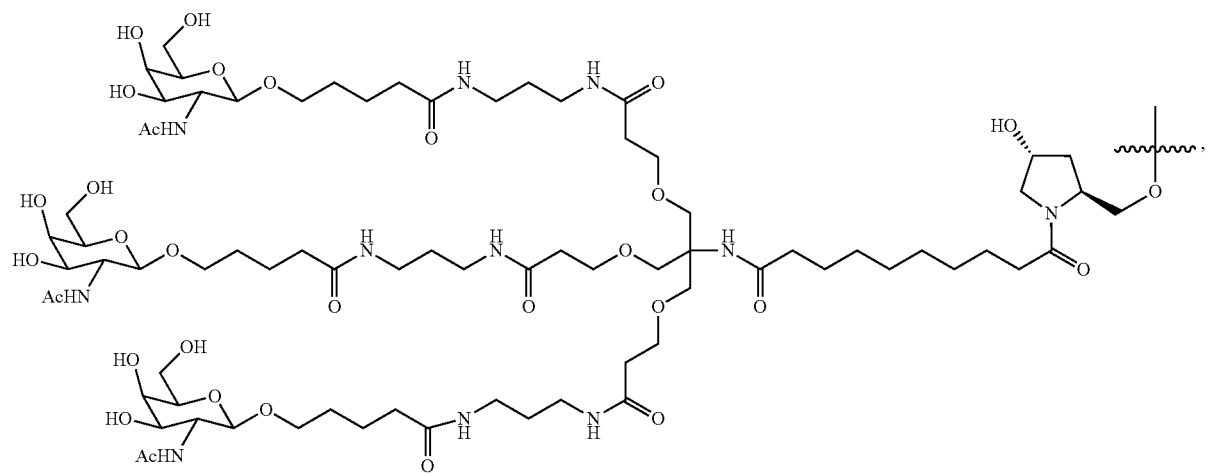

(Formula XXXIX)

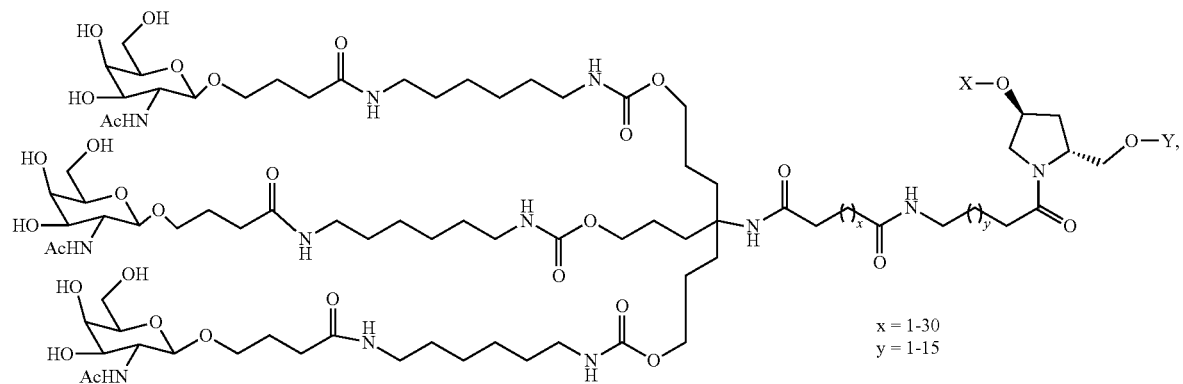

x = 1-30
y = 1-15

-continued
(Formula XL)
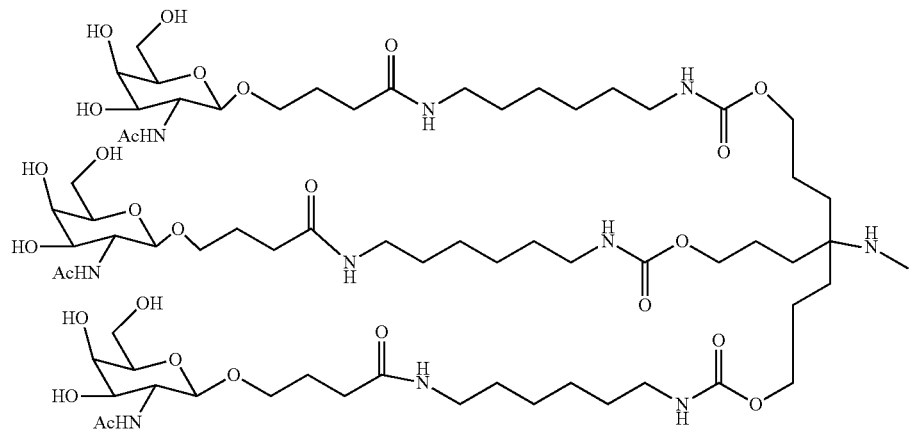
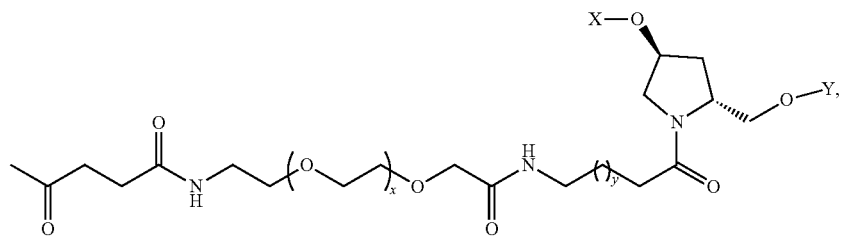
x = 1-30
y = 1-15
(Formula XLI)
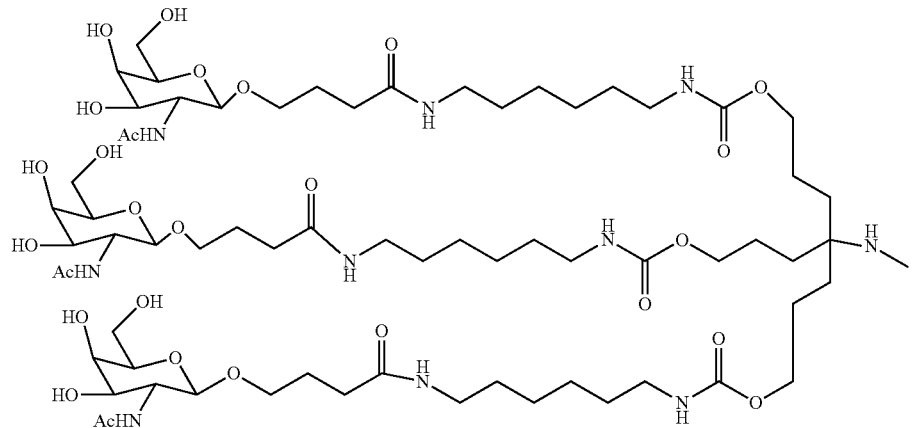
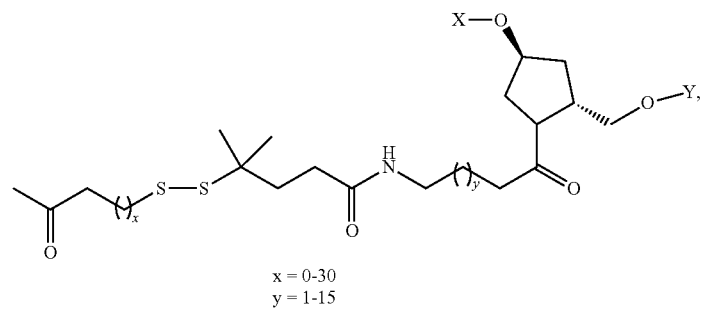
x = 0-30
y = 1-15

(Formula XLII)
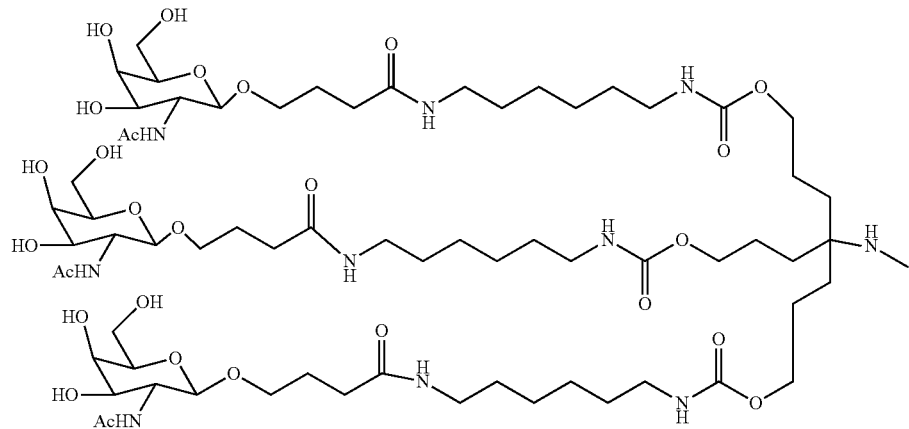
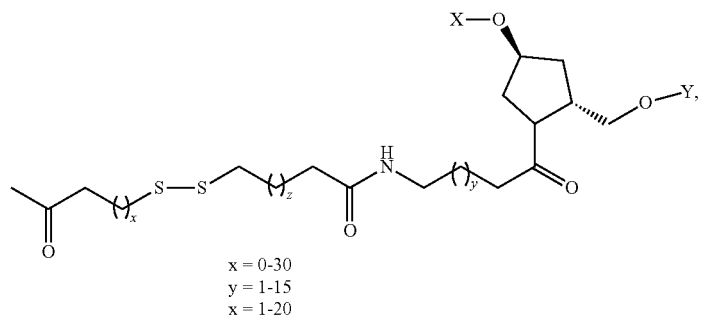
x = 0-30
y = 1-15
x = 1-20
(Formula XLIII)
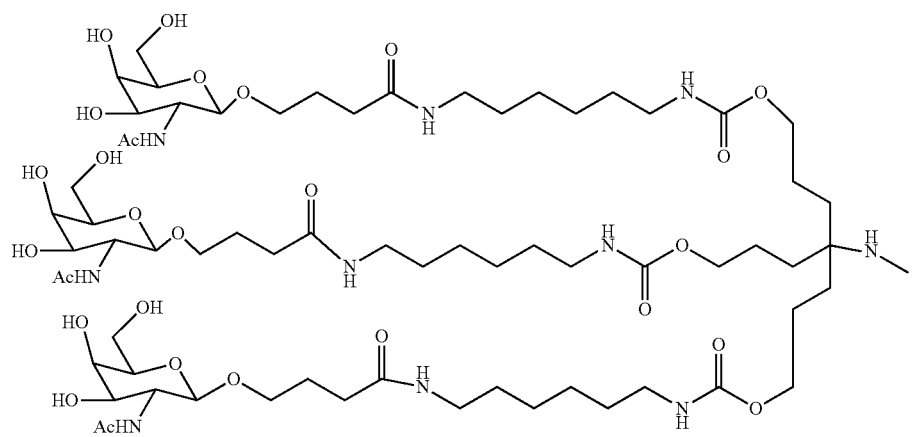
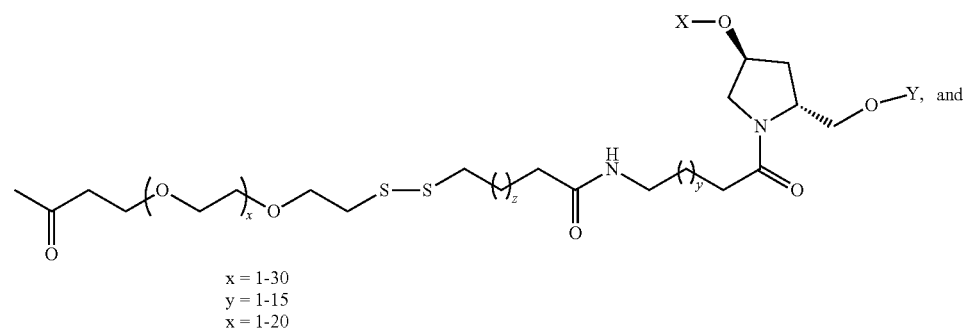
x = 1-30
y = 1-15
x = 1-20

(Formula XLIV)

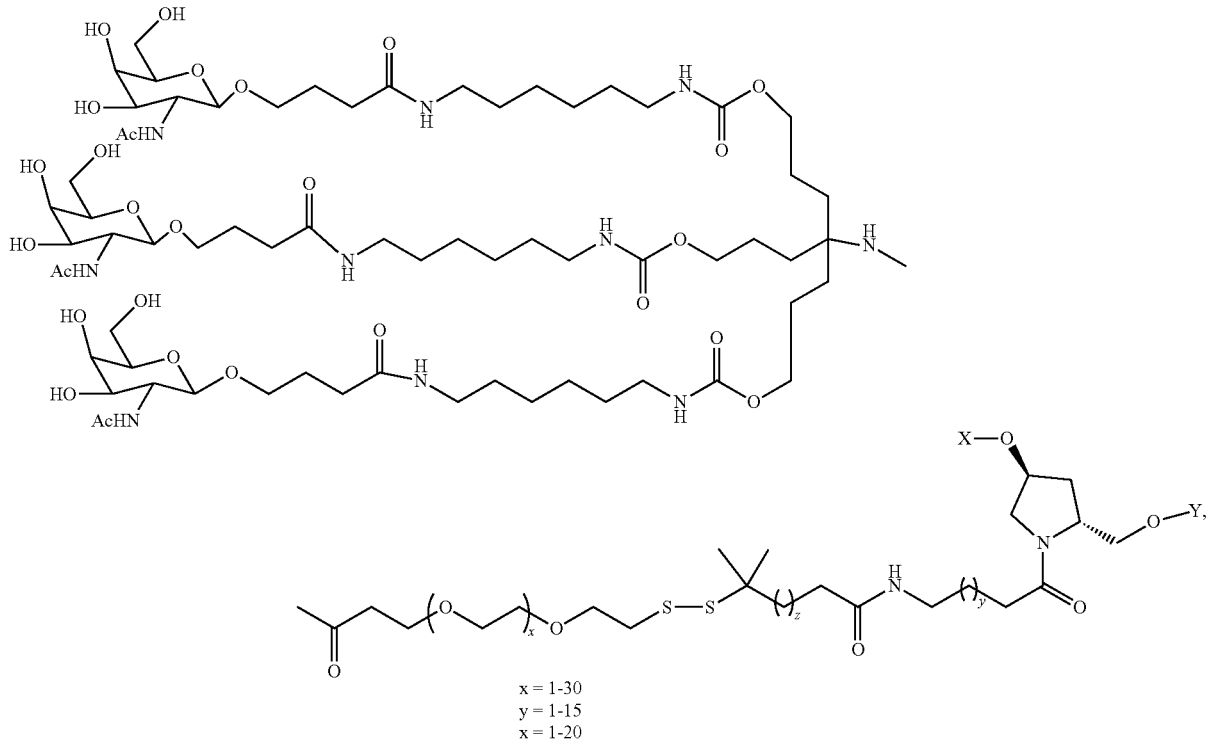

x = 1-30
y = 1-15
x = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XLV)-(XLVI):

Formula XXXXV

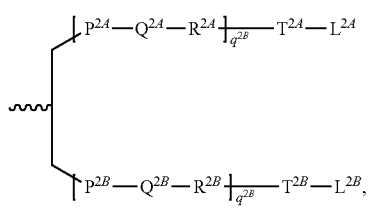

Formula XLVI

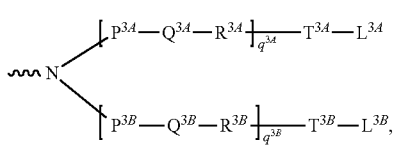

Formula XLVII

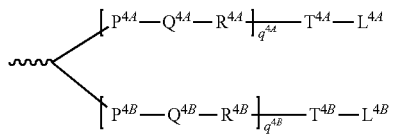

Formula XLVIII

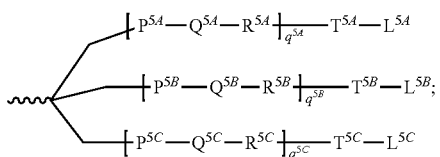

wherein:
q2A, q2B, q3A, q3B, q4A, q4B, q5A, q5B and q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), CH$_2$, CH$_2$NH or CH$_2$O;
$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), SO$_2$, N(R$^N$), C(R')=C(R''), C≡C or C(O);
$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, CH$_2$, C(O)O, C(O)NH, NHCH(R$^a$)C(O), —C(O)CHR$^a$—NH—, CO, CH=N—O,

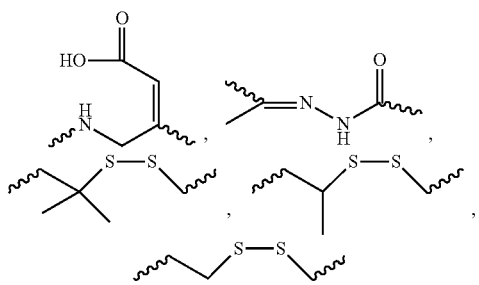

or heterocyclyl; $L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

Formula XLIX

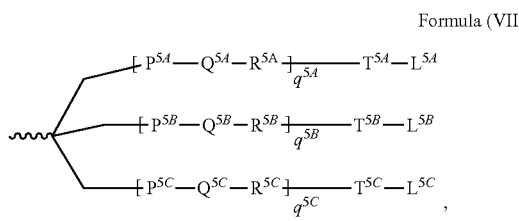

Formula (VII wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. Patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), a thioether, e.g., hexyl-S-tritylthiol (Manoharan et al., *Ann. N.Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject susceptible to or diagnosed with a PNPLA3-associated disorder, e.g., NAFLD) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) Trends Cell. Biol. 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. RNA interference has also shown success with local delivery to the CNS by direct injection (Dorn, G., et al. (2004) Nucleic Acids 32:e49; Tan, P H., et al (2005) Gene Ther. 12:59-66; Makimura, H., et al (2002) BMC Neurosci. 3:18; Shishkina, G T., et al (2004) Neuroscience 129:521-528; Thakker, E R., et al (2004) Proc. Natl. Acad. Sci. U.S.A. 101:17270-17275; Akaneya, Y., et al (2005) J. Neurophysiol. 93:594-602). Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) Nature 432:173-178).

In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) Journal of Controlled Release 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) J. Mol. Biol 327:761-766; Verma, U N, et al (2003) Clin. Cancer Res. 9:1291-1300; Arnold, A S et al (2007) J. Hypertens. 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), "solid nucleic acid lipid particles" (Zimmermann, T S, et al (2006) Nature 441:111-114), cardiolipin (Chien, P Y, et al (2005) Cancer Gene Ther. 12:321-328; Pal, A, et al (2005) Int J. Oncol. 26:1087-1091), polyethyleneimine (Bonnet M E, et al (2008) Pharm. Res. August 16 Epub ahead of print; Aigner, A. (2006) J. Biomed. Biotechnol. 71659), Arg-Gly-Asp (RGD) peptides (Liu, S. (2006) Mol. Pharm. 3:472-487), and polyamidoamines (Tomalia, D A, et al (2007) Biochem. Soc. Trans. 35:61-67; Yoo, H., et al (1999) Pharm. Res. 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting the PNPLA3 gene can be expressed from transcription units inserted into DNA or RNA vectors (see, e.g., Couture, A, et al., TIG. (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., Proc. Natl. Acad. Sci. USA (1995) 92:1292).

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for preventing or treating a PNPLA3-associated disorder, e.g., hypertriglyceridemia. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of a PNPLA3 gene.

In some embodiments, the pharmaceutical compositions of the invention are sterile. In another embodiment, the pharmaceutical compositions of the invention are pyrogen free.

The pharmaceutical compositions of the invention may be administered in dosages sufficient to inhibit expression of a PNPLA3 gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, preferably about 0.3 mg/kg and about 3.0 mg/kg. A repeat-dose regimen may include administration of a therapeutic amount of iRNA on a regular basis, such as every month, once every 3-6 months, or once a year. In certain embodiments, the iRNA is administered about once per month to about once per six months.

After an initial treatment regimen, the treatments can be administered on a less frequent basis. Duration of treatment can be determined based on the severity of disease.

In other embodiments, a single dose of the pharmaceutical compositions can be long lasting, such that doses are administered at not more than 1, 2, 3, or 4 month intervals. In some embodiments of the invention, a single dose of the pharmaceutical compositions of the invention is administered about once per month. In other embodiments of the invention, a single dose of the pharmaceutical compositions of the invention is administered quarterly (i.e., about every three months). In other embodiments of the invention, a single dose of the pharmaceutical compositions of the invention is administered twice per year (i.e., about once every six months).

The skilled artisan will appreciate that certain factors can influence the dosage and timing required to effectively treat a subject, including but not limited to mutations present in the subject, previous treatments, the general health or age of the subject, and other diseases present. Moreover, treatment of a subject with a prophylactically or therapeutically effective amount, as appropriate, of a composition can include a single treatment or a series of treatments.

The iRNA can be delivered in a manner to target a particular tissue (e.g., hepatocytes).

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers.

A. Additional Formulations i. Emulsions

The compositions of the present invention can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

The application of emulsion formulations via dermatological, oral, and parenteral routes, and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

ii. Microemulsions

In one embodiment of the present invention, the compositions of iRNAs and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215).

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers and their use in manufacture of pharmaceutical compositions and delivery of pharmaceutical agents are well known in the art.

v. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Such agent are well known in the art.

vi. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, or aromatic substances, and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating a PNPLA33-associated disorder, e.g., NAFLD.

Toxicity and prophylactic efficacy of such compounds can be determined by standard pharmaceutical procedures in cell cultures or experimental animals, e.g., for determining the LD50 (the dose lethal to 50% of the population) and the ED50 (the dose prophylactically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50, preferably an ED80 or ED90, with little or no toxicity. The dosage can vary within this range depending upon the dosage form employed and the route of administration utilized. For any compound used in the methods featured in the invention, the prophylactically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) or higher levels of inhibition as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents used for the prevention or treatment of aPNPLA3-associated disorder, e.g., NAFLD. In any event, the administering physician can adjust the amount and timing of iRNA administration on the basis of results observed using standard measures of efficacy known in the art or described herein.

VI. Methods for Inhibiting PNPLA3 Expression

The present invention also provides methods of inhibiting expression of a PNPLA3 gene in a cell. The methods include contacting a cell with an RNAi agent, e.g., double stranded RNA agent, in an amount effective to inhibit expression of PNPLA3 in the cell, thereby inhibiting expression of PNPLA3 in the cell.

Contacting of a cell with an iRNA, e.g., a double stranded RNA agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In preferred embodiments, the targeting ligand is a carbohydrate moiety, e.g., a GalNAc$_3$ ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of a PNPLA3" is intended to refer to inhibition of expression of any PNPLA3 gene (such as, e.g., a mouse PNPLA33 gene, a rat PNPLA3 gene, a monkey PNPLA3 gene, or a human PNPLA3 gene) as well as variants or mutants of a PNPLA3 gene. Thus, the PNPLA3 gene may be a wild-type PNPLA3 gene, a mutant PNPLA3 gene, or a transgenic PNPLA3 gene in the context of a genetically manipulated cell, group of cells, or organism.

"Inhibiting expression of a PNPLA3 gene" includes any level of inhibition of aPNPLA3 gene, e.g., at least partial suppression of the expression of a PNPLA3 gene. The expression of the PNPLA3 gene may be assessed based on the level, or the change in the level, of any variable associated with PNPLA3 gene expression, e.g., PNPLA3 mRNA level or PNPLA3 protein level. This level may be assessed in an individual cell or in a group of cells, including, for example, a sample derived from a subject. It is understood that PNPLA3 is expressed predominantly in the liver, but also in the brain, gall bladder, heart, and kidney, and is present in circulation.

Inhibition may be assessed by a decrease in an absolute or relative level of one or more variables that are associated with PNPLA3 expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a PNPLA3 gene is inhibited by at least 50%, 55%, 60%, 65%, 70%, 75%, 80%, 85%, 90%, or 95%, or to below the level of detection of the assay. In preferred embodiments, expression of a PNPLA3 gene is inhibited by at least 70%. It is further understood that inhibition of PNPLA3 expression in certain tissues, e.g., in liver, without a significant inhibition of expression in other tissues, e.g., brain, may be desirable. In preferred embodiments, expression level is determined using the assay method provided in Example 2 with a 10 nM siRNA concentration in the appropriate species matched cell line.

In certain embodiments, inhibition of expression in vivo is determined by knockdown of the human gene in a rodent expressing the human gene, e.g., an AAV-infected mouse expressing the human target gene (i.e., PNPLA3), e.g., when administered as a single dose, e.g., at 3 mg/kg at the nadir of RNA expression. Knockdown of expression of an endogenous gene in a model animal system can also be determined, e.g., after administration of a single dose at, e.g., 3 mg/kg at the nadir of RNA expression. Such systems are useful when the nucleic acid sequence of the human gene and the model animal gene are sufficiently close such that the human iRNA provides effective knockdown of the model animal gene. RNA expression in liver is determined using the PCR methods provided in Example 2.

Inhibition of the expression of a PNPLA3 gene may be manifested by a reduction of the amount of mRNA expressed by a first cell or group of cells (such cells may be present, for example, in a sample derived from a subject) in which a PNPLA3 gene is transcribed and which has or have been treated (e.g., by contacting the cell or cells with an iRNA of the invention, or by administering an iRNA of the invention to a subject in which the cells are or were present) such that the expression of a PNPLA3 gene is inhibited, as compared to a second cell or group of cells substantially identical to the first cell or group of cells but which has not or have not been so treated (control cell(s) not treated with an iRNA or not treated with an iRNA targeted to the gene of interest). In preferred embodiments, the inhibition is assessed by the method provided in Example 2 using a 10 nM siRNA concentration in the species matched cell line and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of a PNPLA3 gene may be assessed in terms of a reduction of a parameter that is functionally linked to PNPLA3 gene expression, e.g., PNPLA3 protein level in blood or serum from a subject. PNPLA3 gene silencing may be determined in any cell expressing PNPLA3, either endogenous or heterologous from an expression construct, and by any assay known in the art.

Inhibition of the expression of a PNPLA3 protein may be manifested by a reduction in the level of the PNPLA3 protein that is expressed by a cell or group of cells or in a subject sample (e.g., the level of protein in a blood sample derived from a subject). As explained above, for the assessment of mRNA suppression, the inhibition of protein expression levels in a treated cell or group of cells may similarly be expressed as a percentage of the level of protein in a control cell or group of cells, or the change in the level of protein in a subject sample, e.g., blood or serum derived therefrom.

A control cell, a group of cells, or subject sample that may be used to assess the inhibition of the expression of a PNPLA3 gene includes a cell, group of cells, or subject sample that has not yet been contacted with an RNAi agent of the invention. For example, the control cell, group of cells, or subject sample may be derived from an individual subject (e.g., a human or animal subject) prior to treatment of the subject with an RNAi agent or an appropriately matched population control.

The level of PNPLA3 mRNA that is expressed by a cell or group of cells may be determined using any method known in the art for assessing mRNA expression. In one embodiment, the level of expression of PNPLA3 in a sample is determined by detecting a transcribed polynucleotide, or portion thereof, e.g., mRNA of the PNPLA3 gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene™ (PreAnalytix™, Switzerland). Typical assay formats utilizing ribonucleic acid hybridization include nuclear run-on assays, RT-PCR, RNase protection assays, northern blotting, in situ hybridization, and microarray analysis.

In some embodiments, the level of expression of PNPLA3 is determined using a nucleic acid probe. The term "probe", as used herein, refers to any molecule that is capable of selectively binding to a specific PNPLA3. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to PNPLA3 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of PNPLA3 mRNA.

An alternative method for determining the level of expression of PNPLA3 in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of PNPLA3 is determined by quantitative fluorogenic RT-PCR (i.e., the TaqMan™ System). In preferred embodiments, expression level is determined by the method provided in Example 2 using, e.g., a 10 nM siRNA concentration, in the species matched cell line.

The expression levels of PNPLA3 mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of PNPLA3 expression level may also comprise using nucleic acid probes in solution.

In preferred embodiments, the level of mRNA expression is assessed using branched DNA (bDNA) assays or real time PCR (qPCR). The use of these methods is described and exemplified in the Examples presented herein. In preferred embodiments, expression level is determined by the method provided in Example 2 using a 10 nM siRNA concentration in the species matched cell line.

The level of PNPLA3 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention are assessed by a decrease in PNPLA3 mRNA or protein level (e.g., in a liver biopsy).

In some embodiments of the methods of the invention, the iRNA is administered to a subject such that the iRNA is delivered to a specific site within the subject. The inhibition of expression of PNPLA3 may be assessed using measurements of the level or change in the level of PNPLA3 mRNA or PNPLA3 protein in a sample derived from fluid or tissue from the specific site within the subject (e.g., liver or blood).

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Prophylactic and Treatment Methods of the Invention

The present invention also provides methods of using an iRNA of the invention or a composition containing an iRNA of the invention to inhibit expression of PNPLA3, thereby preventing or treating an PNPLA3-associated disorder, e.g., fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). In the methods of the invention the cell may be contacted with the siRNA in vitro or in vivo, i.e., the cell may be within a subject.

A cell suitable for treatment using the methods of the invention may be any cell that expresses an PNPLA3 gene, e.g., a liver cell, a brain cell, a gall bladder cell, a heart cell, or a kidney cell, but preferably a liver cell. A cell suitable for use in the methods of the invention may be a mammalian cell, e.g., a primate cell (such as a human cell, including human cell in a chimeric non-human animal, or a non-human primate cell, e.g., a monkey cell or a chimpanzee cell), or a non-primate cell. In certain embodiments, the cell is a human cell, e.g., a human liver cell. In the methods of the invention, PNPLA3 expression is inhibited in the cell by at least 50, 55, 60, 65, 70, 75, 80, 85, 90, or 95, or to a level below the level of detection of the assay.

The in vivo methods of the invention may include administering to a subject a composition containing an iRNA, where the iRNA includes a nucleotide sequence that is complementary to at least a part of an RNA transcript of the PNPLA3 gene of the mammal to which the RNAi agent is to be administered. The composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intramuscular injection.

In one aspect, the present invention also provides methods for inhibiting the expression of an PNPLA3 gene in a mammal. The methods include administering to the mammal a composition comprising a dsRNA that targets a PNPLA3 gene in a cell of the mammal and maintaining the mammal for a time sufficient to obtain degradation of the mRNA transcript of the PNPLA3 gene, thereby inhibiting expression of the PNPLA3 gene in the cell. Reduction in gene expression can be assessed by any methods known in the art and by methods, e.g. qRT-PCR, described herein, e.g., in Example 2. Reduction in protein production can be assessed by any methods known it the art, e.g. ELISA. In certain embodiments, a puncture liver biopsy sample serves as the tissue material for monitoring the reduction in the PNPLA3 gene or protein expression. In other embodiments, a blood sample serves as the subject sample for monitoring the reduction in the PNPLA3 protein expression.

The present invention further provides methods of treatment in a subject in need thereof, e.g., a subject diagnosed with a PNPLA3-associated disorder, such as, fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD).

The present invention further provides methods of prophylaxis in a subject in need thereof. The treatment methods of the invention include administering an iRNA of the invention to a subject, e.g., a subject that would benefit from a reduction of PNPLA3 expression, in a prophylactically effective amount of an iRNA targeting a PNPLA3 gene or a pharmaceutical composition comprising an iRNA targeting a PNPLA3 gene.

In one aspect, the present invention provides methods of treating a subject having a disorder that would benefit from reduction in PNPLA3 expression, e.g., a PNPLA3-associated disease, such as a chronic fibro-inflammatory liver disease (e.g., cancer, e.g., hepatocellular carcinoma, nonalcoholic steatohepatitis (NASH), cirrhosis of the liver, inflammation of the liver, hepatocellular necrosis, liver fibrosis, and nonalcoholic fatty liver disease (NAFLD). In one embodiment, the chronic fibro-inflammatory liver disease is NASH.

In one embodiment, a PNPLA3-associated disease is selected from the group consisting of fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD).

As used herein, "nonalcoholic fatty liver disease," used interchangeably with the term "NAFLD," refers to a disease defined by the presence of macrovascular steatosis in the presence of less than 20 gm of alcohol ingestion per day. NAFLD is the most common liver disease in the United States, and is commonly associated with insulin resistance/type 2 diabetes mellitus and obesity. NAFLD is manifested by steatosis, steatohepatitis, cirrhosis, and sometimes hepatocellular carcinoma. For a review of NAFLD, see Tolman and Dalpiaz (2007) Ther. Clin. Risk. Manag., 3(6):1153-1163 the entire contents of which are incorporated herein by reference.

As used herein, the terms "steatosis," "hepatic steatosis," and "fatty liver disease" refer to the accumulation of triglycerides and other fats in the liver cells.

As used herein, the term "Nonalcoholic steatohepatitis" or "NASH" refers to liver inflammation and damage caused by a buildup of fat in the liver. NASH is part of a group of conditions called nonalcoholic fatty liver disease (NAFLD). NASH resembles alcoholic liver disease, but occurs in people who drink little or no alcohol. The major feature in NASH is fat in the liver, along with inflammation and damage. Most people with NASH feel well and are not aware that they have a liver problem. Nevertheless, NASH can be severe and can lead to cirrhosis, in which the liver is permanently damaged and scarred and no longer able to work properly. NASH is usually first suspected in a person who is found to have elevations in liver tests that are included in routine blood test panels, such as alanine aminotransferase (ALT) or aspartate aminotransferase (AST). When further evaluation shows no apparent reason for liver disease (such as medications, viral hepatitis, or excessive use of alcohol) and when x rays or imaging studies of the liver show fat, NASH is suspected. The only means of proving a diagnosis of NASH and separating it from simple fatty liver is a liver biopsy.

As used herein, the term "cirrhosis," defined histologically, is a diffuse hepatic process characterized by fibrosis and conversion of the normal liver architecture into structurally abnormal nodules.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from an inhibition of PNPLA3 gene expression are subjects susceptible to or diagnosed with an PNPLA3-associated disorder, such as fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD).

In an embodiment, the method includes administering a composition featured herein such that expression of the target a PNPLA3 gene is decreased, such as for about 1, 2, 3, 4, 5, 6, 1-6, 1-3, or 3-6 months per dose. In certain embodiments, the composition is administered once every 3-6 months.

Preferably, the iRNAs useful for the methods and compositions featured herein specifically target RNAs (primary or processed) of the target a PNPLA3 gene. Compositions and methods for inhibiting the expression of these genes using iRNAs can be prepared and performed as described herein.

Administration of the iRNA according to the methods of the invention may result prevention or treatment of a PNPLA3-associated disorder, e.g., fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD).

Subjects can be administered a therapeutic amount of iRNA, such as about 0.01 mg/kg to about 200 mg/kg.

The iRNA is preferably administered subcutaneously, i.e., by subcutaneous injection. One or more injections may be used to deliver the desired dose of iRNA to a subject. The injections may be repeated over a period of time.

The administration may be repeated on a regular basis. In certain embodiments, after an initial treatment regimen, the treatments can be administered on a less frequent basis. A repeat-dose regimen may include administration of a therapeutic amount of iRNA on a regular basis, such as once per month to once a year. In certain embodiments, the iRNA is administered about once per month to about once every three months, or about once every three months to about once every six months.

The invention further provides methods and uses of an iRNA agent or a pharmaceutical composition thereof for treating a subject that would benefit from reduction and/or inhibition of PNPLA3 gene expression, e.g., a subject having an PNPLA3-associated disease, in combination with other pharmaceuticals and/or other therapeutic methods, e.g., with known pharmaceuticals and/or known therapeutic methods, such as, for example, those which are currently employed for treating these disorders.

Accordingly, in some aspects of the invention, the methods which include either a single iRNA agent of the invention, further include administering to the subject one or more additional therapeutic agents.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

Examples of additional therapeutic agents include those known to treat hypertriglyceridemia and other diseases that are caused by, associated with or are a consequence of hypertriglyceridemia. For example, an iRNA featured in the invention can be administered with, e.g., Examples of such agents include, but are not limited to an HMG-CoA reductase inhibitor (e.g., a statin), a fibrate, a bile acid sequestrant, niacin, an antiplatelet agent, an angiotensin converting enzyme inhibitor, an angiotensin II receptor antagonist (e.g., losartan potassium, such as Merck & Co.'s Cozaar®), an acylCoA cholesterol acetyltransferase (ACAT) inhibitor, a cholesterol absorption inhibitor, a cholesterol ester transfer protein (CETP) inhibitor, a microsomal triglyceride transfer protein (MTTP) inhibitor, a cholesterol modulator, a bile acid modulator, a peroxisome proliferation activated receptor (PPAR) agonist, a gene-based therapy, a composite vascular protectant (e.g., AGI-1067, from Atherogenics), a glycoprotein IIb/IIIa inhibitor, aspirin or an aspirin-like compound, an IBAT inhibitor (e.g., 5-8921, from Shionogi), a squalene synthase inhibitor, a monocyte chemoattractant protein (MCP)-I inhibitor, or fish oil. Exemplary HMG-CoA reductase inhibitors include atorvastatin (Pfizer's Lipitor®/Tahor/Sortis/Torvast/Cardyl), pravastatin (Bristol-Myers Squibb's Pravachol, Sankyo's Mevalotin/Sanaprav), simvastatin (Merck's Zocor®/Sinvacor, Boehringer Ingelheim's Denan, Banyu's Lipovas), lovastatin (Merck's Mevacor/Mevinacor, Bexal's Lovastatina, Cepa; Schwarz Pharma's Liposcler), fluvastatin (Novartis' Lescol®/Locol/Lochol, Fujisawa's Cranoc, Solvay's Digaril), cerivastatin (Bayer's Lipobay/GlaxoSmithKline's Baycol), rosuvastatin (AstraZeneca's Crestor®), and pitivastatin (itavastatin/risivastatin) (Nissan Chemical, Kowa Kogyo, Sankyo, and Novartis). Exemplary fibrates include, e.g., bezafibrate (e.g., Roche's Befizal®/Cedur®/Bezalip®, Kissei's Bezatol), clofibrate (e.g., Wyeth's Atromid-S®), fenofibrate (e.g., Fournier's Lipidil/Lipantil, Abbott's Tricor®, Takeda's Lipantil, generics), gemfibrozil (e.g., Pfizer's Lopid/Lipur) and ciprofibrate (Sanofi-Synthelabo's Modalim®). Exemplary bile acid sequestrants include, e.g., cholestyramine (Bristol-Myers Squibb's Questran® and Questran Light™) colestipol (e.g., Pharmacia's Colestid), and colesevelam (Genzyme/Sankyo's WelChol™). Exemplary niacin therapies include, e.g., immediate release formulations, such as Aventis' Nicobid, Upsher-Smith's Niacor, Aventis' Nicolar, and Sanwakagaku's Perycit. Niacin extended release formulations include, e.g., Kos Pharmaceuticals' Niaspan and Upsher-Smith's SIo-Niacin. Exemplary antiplatelet agents include, e.g., aspirin (e.g., Bayer's aspirin), clopidogrel (Sanofi-Synthelabo/Bristol-Myers Squibb's Plavix), and ticlopidine (e.g., Sanofi-Synthelabo's Ticlid and Daiichi's Panaldine). Other aspirin-like compounds useful in combination with a dsRNA targeting PNPLA3 include, e.g., Asacard (slow-release aspirin, by Pharmacia) and Pamicogrel (Kanebo/Angelini Ricerche/CEPA). Exemplary angiotensin-converting enzyme inhibitors include, e.g., ramipril (e.g., Aventis' Altace) and enalapril (e.g., Merck & Co.'s Vasotec). Exemplary acyl CoA cholesterol acetyltransferase (AC AT) inhibitors include, e.g., avasimibe (Pfizer), eflucimibe (BioMsrieux Pierre Fabre/Eli Lilly), CS-505 (Sankyo and Kyoto), and SMP-797 (Sumito). Exemplary cholesterol absorption inhibitors include, e.g., ezetimibe (Merck/Schering-Plough Pharmaceuticals Zetia®) and Pamaqueside (Pfizer). Exemplary CETP inhibitors include, e.g., Torcetrapib (also called CP-529414, Pfizer), JTT-705 (Japan Tobacco), and CETi-I (Avant Immunotherapeutics). Exemplary microsomal triglyceride transfer protein (MTTP) inhibitors include, e.g., implitapide (Bayer), R-103757 (Janssen), and CP-346086 (Pfizer). Other exemplary cholesterol modulators include, e.g., NO-1886 (Otsuka/TAP Pharmaceutical), CI-1027 (Pfizer), and WAY-135433 (Wyeth-Ayerst).

Exemplary bile acid modulators include, e.g., HBS-107 (Hisamitsu/Banyu), Btg-511 (British Technology Group), BARI-1453 (Aventis), S-8921 (Shionogi), SD-5613 (Pfizer), and AZD-7806 (AstraZeneca). Exemplary peroxisome proliferation activated receptor (PPAR) agonists include, e.g., tesaglitazar (AZ-242) (AstraZeneca), Netoglitazone (MCC-555) (Mitsubishi/Johnson & Johnson), GW-409544 (Ligand Pharmaceuticals/GlaxoSmithKline), GW-501516 (Ligand Pharmaceuticals/GlaxoSmithKline), LY-929 (Ligand Pharmaceuticals and Eli Lilly), LY-465608 (Ligand Pharmaceuticals and Eli Lilly), LY-518674 (Ligand Pharmaceuticals and Eli Lilly), and MK-767 (Merck and Kyorin). Exemplary gene-based therapies include, e.g., AdGWEGF 121.10 (GenVec), ApoA1 (UCB Pharma/Groupe Fournier), EG-004 (Trinam) (Ark Therapeutics), and ATP-binding cassette transporter-A1 (ABCA1) (CV Therapeutics/Incyte, Aventis, Xenon). Exemplary Glycoprotein IIb/IIIa inhibitors include, e.g., roxifiban (also called DMP754, Bristol-Myers Squibb), Gantofiban (Merck KGaA/Yamanouchi), and Cromafiban (Millennium Pharmaceuticals). Exemplary squalene synthase inhibitors include, e.g., BMS-1884941 (Bristol-Myers Squibb), CP-210172 (Pfizer), CP-295697 (Pfizer), CP-294838 (Pfizer), and TAK-475 (Takeda). An exemplary MCP-I inhibitor is, e.g., RS-504393 (Roche Bioscience). The anti-atherosclerotic agent BO-653 (Chugai Pharmaceuticals), and the nicotinic acid derivative Nyclin (Yamanouchi Pharmaceuticals) are also appropriate for administering in combination with a dsRNA featured in the invention. Exemplary combination therapies suitable for administration with a dsRNA targeting PNPLA3 include, e.g., advicor (Niacin/lovastatin from Kos Pharmaceuticals), amlodipine/atorvastatin (Pfizer), and ezetimibe/simvastatin (e.g., Vytorin® 10/10, 10/20, 10/40, and 10/80 tablets by Merck/Schering-Plough Pharmaceuticals). Agents for treating hypertriglyceridemia, and suitable for administration in combination with a dsRNA targeting PNPLA3 include, e.g., lovastatin, niacin Altoprev® Extended-Release Tablets (Andrx Labs), lovastatin Caduet® Tablets (Pfizer), amlodipine besylate, atorvastatin calcium Crestor® Tablets (AstraZeneca), rosuvastatin calcium Lescol® Capsules (Novartis), fluvastatin sodium Lescol® (Reliant, Novartis), fluvastatin sodium Lipitor® Tablets (Parke-Davis), atorvastatin calcium Lofibra® Capsules (Gate), Niaspan Extended-Release Tablets (Kos), niacin Pravachol Tablets (Bristol-Myers Squibb), pravastatin sodium TriCor® Tablets (Abbott), fenofibrate Vytorin® 10/10 Tablets (Merck/Schering-Plough Pharmaceuticals), ezetimibe, simvastatin WelChol™ Tablets (Sankyo), colesevelam hydrochloride Zetia® Tablets (Schering), ezetimibe Zetia® Tablets (Merck/Schering-Plough Pharmaceuticals), and ezetimibe Zocor® Tablets (Merck).

In some embodiments, an iRNA featured in the invention can be administered with, e.g., pyridoxine, an ACE inhibitor (angiotensin converting enzyme inhibitors), e.g., benazepril (Lotensin); an angiotensin II receptor antagonist (ARB) (e.g., losartan potassium, such as Merck & Co.'s Cozaar®), e.g., Candesartan (Atacand); an HMG-CoA reductase inhibitor (e.g., a statin); calcium binding agents, e.g., Sodium cellulose phosphate (Calcibind); diuretics, e.g., thiazide diuretics, such as hydrochlorothiazide (Microzide); an insulin sensitizer, such as the PPARγ agonist pioglitazone, a glp-1r agonist, such as liraglutatide, vitamin E, an SGLT2 inhibitor, a DPPIV inhibitor, and kidney/liver transplant; or a combination of any of the foregoing.

In one embodiment, an iRNA agent is administered in combination with an ezetimibe/simvastatin combination (e.g., Vytorin® (Merck/Schering-Plough Pharmaceuticals)). In one embodiment, the iRNA agent is administered to the patient, and then the additional therapeutic agent is administered to the patient (or vice versa). In another embodiment, the iRNA agent and the additional therapeutic agent are administered at the same time.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

In one embodiment, an iRNA agent is administered in combination with an ezetimibe/simvastatin combination (e.g., Vytorin® (Merck/Schering-Plough Pharmaceuticals)). In one embodiment, the iRNA agent is administered to the patient, and then the additional therapeutic agent is administered to the patient (or vice versa). In another embodiment, the iRNA agent and the additional therapeutic agent are administered at the same time.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

VIII. Kits

In certain aspects, the instant disclosure provides kits that include a suitable container containing a pharmaceutical formulation of a siRNA compound, e.g., a double-stranded siRNA compound, or siRNA compound, (e.g., a precursor, e.g., a larger siRNA compound which can be processed into a siRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe), or means for measuring the inhibition of PNPLA3 (e.g., means for measuring the inhibition of PNPLA3 mRNA, PNPLA3 protein, and/or PNPLA3 activity). Such means for measuring the inhibition of PNPLA3 may comprise a means for obtaining a sample from a subject, such as, e.g., a plasma sample. The kits of the invention may optionally further comprise means for determining the therapeutically effective or prophylactically effective amount.

In certain embodiments the individual components of the pharmaceutical formulation may be provided in one container, e.g., a vial or a pre-filled syringe. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

This invention is further illustrated by the following examples which should not be construed as limiting. The entire contents of all references, patents and published patent applications cited throughout this application, as well as the informal Sequence Listing and Figures, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the human Patatin-Like Phospholipase Domain Containing 3 (PNPLA3) gene (human: NCBI refseqID NM_025225.2; NCBI GeneID: 80339) were designed using custom R and Python scripts. The human NM_025225.2 REFSEQ mRNA, has a length of 2805 bases.

Detailed lists of the unmodified PNPLA3 sense and antisense strand nucleotide sequences are shown in Tables 2, 4, 6, 8, and 10. Detailed lists of the modified PNPLA3 sense and antisense strand nucleotide sequences are shown in Tables 3, 5, 7, 9, 11, 21, 24, 27, and 30.

It is to be understood that, throughout the application, a duplex name without a decimal is equivalent to a duplex name with a decimal which merely references the batch number of the duplex. For example, AD-959917 is equivalent to AD-959917.1.

siRNA Synthesis siRNAs were designed, synthesized, and prepared using methods known in the art.

Briefly, siRNA sequences were synthesized on a 1 μmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O-methyl, RNA, DNA) were obtained from Thermo-Fisher (Milwaukee, Wis.), Hongene (China), or Chemgenes (Wilmington, Mass., USA). Additional phosphoramidite monomers were procured from commercial suppliers, prepared in-house, or procured using custom synthesis from various CMOs.

Phosphoramidites were prepared at a concentration of 100 mM in either acetonitrile or 9:1 acetonitrile:DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene) amino)-3H-1,2,4-dithiazole-3-thione (DDTT, obtained from Chemgenes (Wilmington, Mass., USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 μL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA.3HF (triethylamine trihydrofluoride). To each oligonucleotide solution in aqueous methylamine was added 200 μL of dimethyl sulfoxide (DMSO) and 300 μL TEA.3HF and the solution was incubated for approximately 30 mins at 60° C. After incubation, the plate was allowed to come to room temperature and crude oligonucleotides were precipitated by the addition of 1 mL of 9:1 acetonitrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 μM in 1× PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

Example 2. In Vitro Screening Methods

Hep3B Cell Culture and 384-Well Transfections

Hep3b cells (ATCC, Manassas, Va.) were grown to near confluence at 37° C. in an atmosphere of 5% $CO_2$ in Eagle's Minimum Essential Medium (Gibco) supplemented with 10% FBS (ATCC) before being released from the plate by trypsinization. Transfection was carried out by adding 14.8 μl of Opti-MEM plus 0.2 μl of Lipofectamine RNAiMax per well (Invitrogen, Carlsbad Calif. cat #13778-150) to 5 μl of each siRNA duplex to an individual well in a 96-well plate. The mixture was then incubated at room temperature for 15 minutes. Eighty μl of complete growth media without antibiotic containing ~2×$10^4$ Hep3B cells were then added to the siRNA mixture. Cells were incubated for 24 hours prior to RNA purification. Single dose experiments were performed at 10 nM and 0.1 nM final duplex concentration and dose response experiments were done using 8×5-fold serial dilutions over the range of 10 nM to 128 μM.

Total RNA Isolation Using DYNABEADS mRNA Isolation Kit (Invitrogen™, Part #. 610-12)

Cells were lysed in 75 μl of Lysis/Binding Buffer containing 3 μL of beads per well and mixed for 10 minutes on an electrostatic shaker. The washing steps were automated on a Biotek EL406, using a magnetic plate support. Beads were washed (in 90 μL) once in Buffer A, once in Buffer B, and twice in Buffer E, with aspiration steps in between. Following a final aspiration, complete 10 μL RT mixture was added to each well, as described below.

cDNA Synthesis Using ABI High Capacity cDNA Reverse Transcription Kit (Applied Biosystems, Foster City, Calif., Cat #4368813)

A master mix of 1 μl 10× Buffer, 0.4 μl 25× dNTPs, 1 μl Random primers, 0.5 μl Reverse Transcriptase, 0.5 μl RNase inhibitor and 6.61 of $H_2O$ per reaction were added per well. Plates were sealed, agitated for 10 minutes on an electrostatic shaker, and then incubated at 37 degrees C. for 2 hours. Following this, the plates were agitated at 80 degrees C. for 8 minutes.

Real Time PCR

Two microlitre (μl) of cDNA were added to a master mix containing 0.5 μl of human GAPDH TaqMan Probe (4326317E), 0.5 µl human PNPLA3, 2 µl nuclease-free water and 5 µl Lightcycler 480 probe master mix (Roche Cat #04887301001) per well in a 384 well plates (Roche cat #04887301001). Real time PCR was done in a LightCycler480 Real Time PCR system (Roche).

To calculate relative fold change, data were analyzed using the ΔΔCt method and normalized to assays performed with cells transfected with 10 nM AD-1955, or mock transfected cells. $IC_{50}$s were calculated using a 4 parameter fit model using XLFit and normalized to cells transfected with AD-1955 or mock-transfected. The sense and antisense sequences of AD-1955 are: sense: cuuAcGcuGAGuAcuucGAdTsdT (SEQ ID NO: 18) and antisense UCGAAGuACUcAGCGuAAGdTsdT (SEQ ID NO: 19).

In Vitro Dual-Luciferase and Endogenous Screening Assays

Cos-7 cells (ATCC, Manassas, Va.) are grown to near confluence at 37° C. in an atmosphere of 5% $CO_2$ in DMEM (ATCC) supplemented with 10% FBS, before being released from the plate by trypsinization. Single-dose experiments were performed at 50 nM, 10 nM, 1 nM, and 0.1 nM. siRNA and psiCHECK2-PNPLA3 (GenBank Accession No. NM_025225.2) plasmid transfections were carried out with a plasmid containing the 3' untranslated region (UTR). Transfection was carried out by adding 5 µL of siRNA duplexes and 5 µL (5 ng) of psiCHECK2 plasmid per well along with 4.9 µL of Opti-MEM plus 0.1 µL of Lipofectamine 2000 per well (Invitrogen, Carlsbad Calif. cat #13778-150) and then incubated at room temperature for 15 minutes. The mixture was then added to the cells which are re-suspended in 35 µL of fresh complete media. The transfected cells were incubated at 37° C. in an atmosphere of 5% $CO_2$.

Forty-eight hours after the siRNAs and psiCHECK2 plasmid are transfected; Firefly (transfection control) and *Renilla* (fused to PNPLA3 target sequence) luciferase were measured. First, media was removed from cells. Then Firefly luciferase activity was measured by adding 20 µL of Dual-Glo® Luciferase Reagent equal to the culture medium volume to each well and mix. The mixture was incubated at room temperature for 30 minutes before luminescence (500 nm) was measured on a Spectramax (Molecular Devices) to detect the Firefly luciferase signal. *Renilla* luciferase activity was measured by adding 20 µL of room temperature of Dual-Glo® Stop & Glo® Reagent to each well and the plates were incubated for 10-15 minutes before luminescence was again measured to determine the *Renilla* luciferase signal. The Dual-Glo® Stop & Glo® Reagent quenches the firefly luciferase signal and sustained luminescence for the *Renilla* luciferase reaction. siRNA activity was determined by normalizing the *Renilla* (PNPLA3) signal to the Firefly (control) signal within each well. The magnitude of siRNA activity was then assessed relative to cells that were transfected with the same vector but were not treated with siRNA or were treated with a non-targeting siRNA. All transfections were done with n=4.

Cell Culture and Transfections

Cells were transfected by adding 4.9 µL of Opti-MEM plus 0.1 µL of RNAiMAX per well (Invitrogen, Carlsbad Calif. cat #13778-150) to 5 µL of siRNA duplexes per well, with 4 replicates of each siRNA duplex, into a 384-well plate, and incubated at room temperature for 15 minutes. Forty µL of MEDIA containing ~$5 \times 10^3$ cells were then added to the siRNA mixture. Cells were incubated for 24 hours prior to RNA purification. Experiments were performed at 50 nM, 10 nM, 1 nM, and 0.1 nM. Transfection experiments were performed in Cos 7 cells.

Total RNA Isolation Using DYNABEADS mRNA Isolation Kit

RNA was isolated using an automated protocol on a BioTek-EL406 platform using DYNABEADs (Invitrogen, cat #61012). Briefly, 70 µL of Lysis/Binding Buffer and 10 µL of lysis buffer containing 3 µL of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µL Wash Buffer A and once with Wash Buffer B. Beads were then washed with 150 µL Elution Buffer, re-captured and supernatant removed.

cDNA Synthesis Using ABI High Capacity cDNA Reverse Transcription Kit (Applied Biosystems, Foster City, Calif., Cat #4368813)

Ten µL of a master mix containing 1 µL 10× Buffer, 0.4 µL 25× dNTPs, 1 µL 10× Random primers, 0.5 µL Reverse Transcriptase, 0.5 µL RNase inhibitor and 6.6 µL of $H_2O$ per reaction was added to RNA isolated above. Plates were sealed, mixed, and incubated on an electromagnetic shaker for 10 minutes at room temperature, followed by 2 hour incubation at 37° C.

Real Time PCR

Two µL of cDNA were added to a master mix containing 0.5 µL of human or mouse GAPDH TaqMan Probe (ThermoFisher cat 4352934E or 4351309) and 0.5 µL of appropriate PNPLA3 probe (commercially available, e.g., from Thermo Fisher) and 5 µL Lightcycler 480 probe master mix (Roche Cat #04887301001) per well in a 384 well plates (Roche cat #04887301001). Real time PCR was done in a LightCycler480 Real Time PCR system (Roche). Each duplex was tested with N=4 and data were normalized to cells transfected with a non-targeting control siRNA. To calculate relative fold change, real time data were analyzed using the ΔΔCt method and normalized to assays performed with cells transfected with a non-targeting control siRNA.

The results of the screening of the dsRNA agents listed in Tables 2 and 3 in Cos 7 cells are shown in Table 12. The results of the screening of the dsRNA agents listed in Tables 4 and 5 in Cos 7 cells are shown in Table 13. The results of the screening of the dsRNA agents listed in Tables 4 and 5 in Hep3B cells are shown in Table 14. The results of the screening of the dsRNA agents listed in Tables 6 and 7 in Cos 7 cells are shown in Table 15. The results of the screening of the dsRNA agents listed in Tables 8 and 9 in Cos 7 cells are shown in Table 16. The results of the screening of the dsRNA agents listed in Tables 8 and 9 in Hep3B cells are shown in Table 17. The results of the screening of the dsRNA agents listed in Tables 10 and 11 in Cos 7 cells are shown in Table 18. The results of the screening of the dsRNA agents listed in Tables 10 and 11 in Hep3B cells are shown in Table 19.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |

TABLE 1-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol (Hyp-(GalNAc-alkyl)3) |
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine-3'-phosphate |
| dTs | 2'-deoxythymidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Chd) | 2'-O-hexadecyl-cytidine-3'-phosphate |
| (Ahd) | 2'-O-hexadecyl-adenosine-3'-phosphate |
| (Ghd) | 2'-O-hexadecyl-guanosine-3'-phosphate |
| (Uhd) | 2'-O-hexadecyl-uridine-3'-phosphate |

TABLE 2

Unmodified Sense and Antisense Strand Sequences of PNPLA3 dsRNA Agents

| Duplex Name | Sense Sequence 5' to 3' | SEQ ID NO: | Range in NM_025225.2 |
|---|---|---|---|
| AD-517197.1 | CAUGAGCAAGAUUUGCAACUU | 20 | 1187-1207 |
| AD-516851.1 | UGAUGCCAAAACAACCAUCAU | 21 | 701-721 |
| AD-516748.1 | AAAGACGAAGUCGUGGAUGCU | 22 | 576-596 |
| AD-517234.1 | GGUGGAUACAUGAGCAAGAUU | 23 | 1179-1199 |
| AD-517354.1 | UCCAGAUAUGCCCGACGAUGU | 24 | 1301-1321 |
| AD-517257.1 | AACUUGCUACCCAUUAGGAUU | 25 | 1203-1223 |
| AD-516739.1 | UCGGUCCAAAGACGAAGUCGU | 26 | 569-589 |
| AD-517258.1 | ACUUGCUACCCAUUAGGAUAU | 27 | 1204-1224 |
| AD-516629.1 | CUUAAGCAAGUUCCUCCGACU | 28 | 440-460 |
| AD-516972.1 | CUGGGAGAGAUAUGCCUUCGU | 29 | 873-893 |
| AD-517623.1 | UCCCAUCUUUGUGCAGCUACU | 30 | 1669-1689 |
| AD-516733.1 | CUGACUUUCGGUCCAAAGACU | 31 | 562-582 |
| AD-517985.1 | ACACCUUUUUCACCUAACUAU | 32 | 2178-2198 |
| AD-516827.1 | GUGAGUGACAACGUACCCUUU | 33 | 678-698 |
| AD-516917.1 | CAAGCUCAGUCUACGCCUCUU | 34 | 797-817 |
| AD-516973.1 | UGGGAGAGAUAUGCCUUCGAU | 35 | 874-894 |
| AD-516978.1 | GAGAUAUGCCUUCGAGGAUAU | 36 | 879-899 |
| AD-517310.1 | GUGGAAUCUGCCAUUGCGAUU | 37 | 1257-1277 |
| AD-516828.1 | UGAGUGACAACGUACCCUUCU | 38 | 679-699 |
| AD-517249.1 | CUUGCUACCCAUUAGGAUAAU | 39 | 1205-1225 |
| AD-517196.1 | GUGGAUACAUGAGCAAGAUUU | 40 | 1180-1200 |
| AD-517322.1 | AUUGCGAUUGUCCAGAGACUU | 41 | 1269-1289 |
| AD-517319.1 | GCCAUUGCGAUUGUCCAGAGU | 42 | 1266-1286 |
| AD-516822.1 | GAGGAGUGAGUGACAACGUAU | 43 | 673-693 |
| AD-516826.1 | AGUGAGUGACAACGUACCCUU | 44 | 677-697 |
| AD-516824.1 | GGAGUGAGUGACAACGUACCU | 45 | 675-695 |
| AD-517517.1 | UUGGGCAAUAAAGUACCUGCU | 46 | 1545-1565 |
| AD-517758.1 | AUGCGUUAAUUCAGCUGGUUU | 47 | 1824-1844 |
| AD-516940.1 | CAGGGAACCUCUACCUUCUCU | 48 | 820-840 |
| AD-517318.1 | UGCCAUUGCGAUUGUCCAGAU | 49 | 1265-1285 |
| AD-517321.1 | CAUUGCGAUUGUCCAGAGACU | 50 | 1268-1288 |
| AD-516747.1 | CAAAGACGAAGUCGUGGAUGU | 51 | 575-595 |
| AD-516737.1 | CUUUCGGUCCAAAGACGAAGU | 52 | 566-586 |
| AD-516742.1 | CGGUCCAAAGACGAAGUCGUU | 53 | 570-590 |
| AD-516977.1 | AGAGAUAUGCCUUCGAGGAUU | 54 | 878-898 |
| AD-516823.1 | AGGAGUGAGUGACAACGUACU | 55 | 674-694 |
| AD-516871.1 | AUCUGCCCUAAAGUCAAGCUU | 56 | 750-770 |

TABLE 2-continued

Unmodified Sense and Antisense Strand Sequences of PNPLA3 dsRNA Agents

| Duplex Name | Sense Sequence 5' to 3' | SEQ ID NO: | Range in NM_025225.2 |
|---|---|---|---|
| AD-516771.1 | CUUCUACAGUGGCCUUAUCCU | 57 | 620-640 |
| AD-517757.1 | CAUGCGUUAAUUCAGCUGGUU | 58 | 1823-1843 |
| AD-516745.1 | UCCAAAGACGAAGUCGUGGAU | 59 | 573-593 |
| AD-517830.1 | GUGGCCCUAUUAAUGGUCAGU | 60 | 1895-1915 |
| AD-516970.1 | UGCUGGGAGAGAUAUGCCUUU | 61 | 871-891 |
| AD-517768.1 | UCAGCUGGUUUGGGAAAUGACU | 62 | 1834-1854 |
| AD-517259.1 | UUGCUACCCAUUAGGAUAAUU | 63 | 1206-1226 |
| AD-516979.1 | AGAUAUGCCUUCGAGGAUAUU | 64 | 880-900 |
| AD-516971.1 | GCUGGGAGAGAUAUGCCUUCU | 65 | 872-892 |
| AD-517838.1 | UUAAUGGUCAGACUGUUCCAU | 66 | 1904-1924 |
| AD-516743.1 | GGUCCAAAGACGAAGUCGUGU | 67 | 571-591 |
| AD-516980.1 | GAUAUGCCUUCGAGGAUAUUU | 68 | 881-901 |
| AD-517771.1 | GCUGGUUGGGAAAUGACACCU | 69 | 1837-1857 |
| AD-516772.1 | UUCUACAGUGGCCUUAUCCCU | 70 | 621-641 |
| AD-517836.1 | UAUUAAUGGUCAGACUGUUCU | 71 | 1902-1922 |
| AD-516741.1 | UUCGGUCCAAAGACGAAGUCU | 72 | 568-588 |
| AD-517353.1 | UUCCAGAUAUGCCCGACGAUU | 73 | 1300-1320 |
| AD-517979.1 | UUUAGAACACCUUUUUCACCU | 74 | 2172-2192 |
| AD-516937.1 | GCACAGGGAACCUCUACCUUU | 75 | 817-837 |
| AD-516976.1 | GAGAGAUAUGCCUUCGAGGAU | 76 | 877-897 |
| AD-516872.1 | UCUGCCCUAAAGUCAAGUCCU | 77 | 751-771 |
| AD-517256.1 | CAACUUGCUACCCAUUAGGAU | 78 | 1202-1222 |
| AD-516825.1 | GAGUGAGUGACAACGUACCCU | 79 | 676-696 |
| AD-516735.1 | GACUUUCGGUCCAAAGACGAU | 80 | 564-584 |
| AD-516588.1 | GGCCAGGAGUCGGAACAUUGU | 81 | 398-418 |
| AD-516738.1 | UUUCGGUCCAAAGACGAAGUU | 82 | 567-587 |
| AD-517314.1 | AAUCUGCCAUUGCGAUUGUCU | 83 | 1261-1281 |
| AD-517805.1 | CAGAGGGUCCCUUACUGACUU | 84 | 1870-1890 |
| AD-517685.1 | UUGGUUUUAUGAAAAGCUAGU | 85 | 1751-1771 |
| AD-517831.1 | UGGCCCUAUUAAUGGUCAGAU | 86 | 1896-1916 |
| AD-516830.1 | AGUGACAACGUACCCUUCAUU | 87 | 681-701 |
| AD-517837.1 | AUUAAUGGUCAGACUGUUCCU | 88 | 1903-1923 |
| AD-517633.1 | GUGCAGCUACCUCCGCAUUGU | 89 | 1679-1699 |
| AD-516855.1 | GCCAAAACAACCAUCACCGUU | 90 | 705-725 |
| AD-516688.1 | AACGUUCUGGUGUCUGACUUU | 91 | 549-569 |
| AD-516630.1 | UUAAGCAAGUUCCUCCGACAU | 92 | 441-461 |
| AD-516835.1 | CAACGUACCCUUCAUUGAUGU | 93 | 686-706 |
| AD-516832.1 | UGACAACGUACCCUUCAUUGU | 94 | 683-703 |
| AD-517834.1 | CCCUAUUAAUGGUCAGACUGU | 95 | 1899-1919 |
| AD-516734.1 | UGACUUUCGGUCCAAAGACGU | 96 | 563-583 |
| AD-517228.1 | GACAAAGGUGGAUACAUGAGU | 97 | 1173-1193 |
| AD-516736.1 | ACUUUCGGUCCAAAGACGAAU | 98 | 565-585 |
| AD-517646.1 | CGCAUUGCUGUGUAGUGACCU | 99 | 1692-1712 |
| AD-517744.1 | UCUAAUACAUCAGCAUGCGUU | 100 | 1810-1830 |
| AD-517509.1 | ACUUCUUCUUGGGCAAUAAAU | 101 | 1537-1557 |
| AD-517746.1 | UAAUACAUCAGCAUGCGUUAU | 102 | 1812-1832 |
| AD-516752.1 | ACGAAGUCGUGGAUGCCUUGU | 103 | 580-600 |
| AD-516746.1 | CCAAAGACGAAGUCGUGGAUU | 104 | 574-594 |
| AD-517227.1 | AGACAAAGGUGGAUACAUGAU | 105 | 1172-1192 |
| AD-516751.1 | GACGAAGUCGUGGAUGCCUUU | 106 | 579-599 |
| AD-517042.1 | CAUCCUCAGAAGGGAUGGAUU | 107 | 964-984 |
| AD-517571.1 | UGAGUCACUUGAGGAGGCGAU | 108 | 1617-1637 |
| AD-517197.1 | AAGUUGCAAAUCUUGCUCAUGUA | 109 | 1185-1207 |
| AD-516851.1 | AUGAUGGUUGUUUUGGCAUCAAU | 110 | 699-721 |
| AD-516748.1 | AGCAUCCACGACUUCGUCUUUGG | 111 | 574-596 |
| AD-517234.1 | AAUCUUGCUCAUGUAUCCACCUU | 112 | 1177-1199 |
| AD-517354.1 | ACAUCGTCGGGCAUAUCUGGAAG | 113 | 1299-1321 |
| AD-517257.1 | AAUCCUAAUGGGUAGCAAGUUGC | 114 | 1201-1223 |
| AD-516739.1 | ACGACUCGUCUUUUGGACCGAAA | 115 | 567-589 |
| AD-517258.1 | AUAUCCTAAUGGGUAGCAAGUUG | 116 | 1202-1224 |
| AD-516629.1 | AGUCGGAGGAACUUGCUUAAGUU | 117 | 438-460 |
| AD-516972.1 | ACGAAGGCAUAUCUCUCCCAGCA | 118 | 871-893 |
| AD-517623.1 | AGUAGCTGCACAAAGAUGGGAAA | 119 | 1667-1689 |
| AD-516733.1 | AGUCUUTGGACCGAAAGUCAGAC | 120 | 560-582 |
| AD-517985.1 | AUAGUUAGGUGAAAAAGGUGUUC | 121 | 2176-2198 |
| AD-516827.1 | AAAGGGUACGUUGUCACUCACUC | 122 | 676-698 |
| AD-516917.1 | AAGAGGCUAGACUGAGCUUGGU | 123 | 795-817 |
| AD-516973.1 | AUCGAAGGCAUAUCUCUCCCAGC | 124 | 872-894 |
| AD-516978.1 | AUAUCCTCGAAGGCAUAUCUCUC | 125 | 877-899 |
| AD-517310.1 | AAUCGCAAUGGCAGAUUCCACAG | 126 | 1255-1277 |
| AD-516828.1 | AGAAGGGUACGUUGUCACUCACU | 127 | 677-699 |
| AD-517249.1 | AUUAUCCUAAUGGGUAGCAAGUU | 128 | 1203-1225 |
| AD-517196.1 | AAAUCUGCUCAUGUAUCCACCU | 129 | 1178-1200 |

TABLE 2-continued

Unmodified Sense and Antisense Strand Sequences of PNPLA3 dsRNA Agents

| Duplex Name | Sense Sequence 5' to 3' | SEQ ID NO: | Range in NM_025225.2 |
|---|---|---|---|
| AD-517322.1 | AAGUCUCUGGACAAUCGCAAUGG | 130 | 1267-1289 |
| AD-517319.1 | ACUCUGGACAAUCGCAAUGGCAG | 131 | 1264-1286 |
| AD-516822.1 | AUACGUTGUCACUCACUCCUCCA | 132 | 671-693 |
| AD-516826.1 | AAGGGUACGUUGUCACUCACUCC | 133 | 675-697 |
| AD-516824.1 | AGGUACGUUGUCACUCACUCCUC | 134 | 673-695 |
| AD-517517.1 | AGCAGGUACUUUAUUGCCCAAGA | 135 | 1543-1565 |
| AD-517758.1 | AAACCAGCUGAAUUAACGCAUGC | 136 | 1822-1844 |
| AD-516940.1 | AGAGAAGGUAGAGGUUCCCUGUG | 137 | 818-840 |
| AD-517318.1 | AUCUGGACAAUCGCAAUGGCAGA | 138 | 1263-1285 |
| AD-517321.1 | AGUCUCTGGACAAUCGCAAUGGC | 139 | 1266-1288 |
| AD-516747.1 | ACAUCCACGACUUCGUCUUUGGA | 140 | 573-595 |
| AD-516737.1 | ACUUCGTCUUUGGACCGAAAGUC | 141 | 564-586 |
| AD-516742.1 | AACGACUUCGUCUUUGGACCGAA | 142 | 568-590 |
| AD-516977.1 | AAUCCUCGAAGGCAUAUCUCUCC | 143 | 876-898 |
| AD-516823.1 | AGUACGTUGUCACUCACUCCUCC | 144 | 672-694 |
| AD-516871.1 | AGACUUGACUUUAGGGCAGAUGU | 145 | 748-770 |
| AD-516771.1 | AGGAUAAGGCCACUGUAGAAGGG | 146 | 618-640 |
| AD-517757.1 | AACCAGCUGAAUUAACGCAUGCU | 147 | 1821-1843 |
| AD-516745.1 | AUCCACGACUUCGUCUUUGGACC | 148 | 571-593 |
| AD-517830.1 | ACUGACCAUUAAUAGGGCCACGA | 149 | 1893-1915 |
| AD-516970.1 | AAAGGCAUAUCUCUCCCAGCACC | 150 | 869-891 |
| AD-517768.1 | AGUCAUUCCCAACCAGCUGAAU | 151 | 1832-1854 |
| AD-517259.1 | AAUUAUCCUAAUGGGUAGCAAGU | 152 | 1204-1226 |
| AD-516979.1 | AAUAUCCUCGAAGGCAUAUCUCU | 153 | 878-900 |
| AD-516971.1 | AGAAGGCAUAUCUCUCCCAGCAC | 154 | 870-892 |
| AD-517838.1 | AUGGAACAGUCUGACCAUUAAUA | 155 | 1902-1924 |
| AD-516743.1 | ACACGACUUCGUCUUUGGACCGA | 156 | 569-591 |
| AD-516980.1 | AAAUAUCCUCGAAGGCAUAUCUC | 157 | 879-901 |
| AD-517771.1 | AGGUGUCAUUCCCAACCAGCUG | 158 | 1835-1857 |
| AD-516772.1 | AGGGAUAAGGCCACUGUAGAAGG | 159 | 619-641 |
| AD-517836.1 | AGAACAGUCUGACCAUUAAUAGG | 160 | 1900-1922 |
| AD-516741.1 | AGACUUCGUCUUUGGACCGAAAG | 161 | 566-588 |
| AD-517353.1 | AAUCGUCGGGCAUAUCUGGAAGC | 162 | 1298-1320 |
| AD-517979.1 | AGGUGAAAAGGUGUUCUAAAAU | 163 | 2170-2192 |
| AD-516937.1 | AAAGGUAGAGGUUCCCUGUGCAG | 164 | 815-837 |
| AD-516976.1 | AUCCUCGAAGGCAUAUCUCUCCC | 165 | 875-897 |
| AD-516872.1 | AGGACUTGACUUUAGGGCAGAUG | 166 | 749-771 |
| AD-517256.1 | AUCCUAAUGGGUAGCAAGUUGCA | 167 | 1200-1222 |
| AD-516825.1 | AGGGUACGUUGUCACUCACUCCU | 168 | 674-696 |
| AD-516735.1 | AUCGUCTUUGGACCGAAAGUCAG | 169 | 562-584 |
| AD-516588.1 | ACAAUGTUCCGACUCCUGGCCUU | 170 | 396-418 |
| AD-516738.1 | AACUUCGUCUUUGGACCGAAAGU | 171 | 565-587 |
| AD-517314.1 | AGACAAUCGCAAUGGCAGAUUCC | 172 | 1259-1281 |
| AD-517805.1 | AAGUCAGUAAGGGACCCUCUGCA | 173 | 1868-1890 |
| AD-517685.1 | ACUAGCUUUCAUAAAACCAACU | 174 | 1749-1771 |
| AD-517831.1 | AUCUGACCAUUAAUAGGGCCACG | 175 | 1894-1916 |
| AD-516830.1 | AAUGAAGGGUACGUUGUCACUCA | 176 | 679-701 |
| AD-517837.1 | AGGAACAGUCUGACCAUUAAUAG | 177 | 1901-1923 |
| AD-517633.1 | ACAAUGCGGAGGUAGCUGCACAA | 178 | 1677-1699 |
| AD-516855.1 | AACGGUGAUGGUUGUUUUGGCAU | 179 | 703-725 |
| AD-516688.1 | AAAGUCAGACACCAGAACGUUUU | 180 | 547-569 |
| AD-516630.1 | AUGUCGGAGGAACUUGCUUAAGU | 181 | 439-461 |
| AD-516835.1 | ACAUCAAUGAAGGGUACGUUGUC | 182 | 684-706 |
| AD-516832.1 | ACAAUGAAGGGUACGUUGUCACU | 183 | 681-703 |
| AD-517834.1 | ACAGUCTGACCAUUAAUAGGGCC | 184 | 1897-1919 |
| AD-516734.1 | ACGUCUTGGACCGAAAGUCAGA | 185 | 561-583 |
| AD-517228.1 | ACUCAUGUAUCCACCUUUGUCUU | 186 | 1171-1193 |
| AD-516736.1 | AUUCGUCUUUGGACCGAAAGUCA | 187 | 563-585 |
| AD-517646.1 | AGGUCACUACACAGCAAUGCGGA | 188 | 1690-1712 |
| AD-517744.1 | AACGCATGCUGAUGUAUUAGAGU | 189 | 1808-1830 |
| AD-517509.1 | AUUUATGCCCAAGAAGAAGUUC | 190 | 1535-1557 |
| AD-517746.1 | AUAACGCAUGCUGAUGUAUUAGA | 191 | 1810-1832 |
| AD-516752.1 | ACAAGGCAUCCACGACUUCGUCU | 192 | 578-600 |
| AD-516746.1 | AAUCCACGACUUCGUCUUUGGAC | 193 | 572-594 |
| AD-517227.1 | AUCAUGTAUCCACCUUUGUCUUU | 194 | 1170-1192 |
| AD-516751.1 | AAAGGCAUCCACGACUUCGUCUU | 195 | 577-599 |
| AD-517042.1 | AAUCCATCCCUUCUGAGGAUGAC | 196 | 962-984 |
| AD-517571.1 | AUCGCCTCCUCAAGUGACUCACA | 197 | 1615-1637 |

TABLE 3

Modified Sense and Antisense Strand Sequences of PNPLA3 dsRNA Agents

| Duplex Name | Sense Sequence 5' to 3' | SEQ ID NO: |
|---|---|---|
| AD-517197.1 | csasugagCfaAfGfAfuuugcaacuuL96 | 198 |
| AD-516851.1 | usgsaugcCfaAfAfAfcaaccaucauL96 | 199 |
| AD-516748.1 | asasagacGfaAfGfUfcguggaugcuL96 | 200 |
| AD-517234.1 | gsgsuggaUfaCfAfUfgagcaagauuL96 | 201 |
| AD-517354.1 | uscscagaUfaUfGfCfccgacgauguL96 | 202 |
| AD-517257.1 | asascuugCfuAfCfCfcauuaggauuL96 | 203 |
| AD-516739.1 | uscsgguCfaAfAfGfacgaagucguL96 | 204 |
| AD-517258.1 | ascsuugcUfaCfCfCfauuaggauauL96 | 205 |
| AD-516629.1 | csusuaagCfaAfGfUfuccuccgacuL96 | 206 |
| AD-516972.1 | csusgggaGfaGfAfUfaugccuucguL96 | 207 |
| AD-517623.1 | uscsccauCfuUfUfGfugcagcuacuL96 | 208 |
| AD-516733.1 | csusgacuUfuCfGfGfuccaaagacuL96 | 209 |
| AD-517985.1 | ascsaccuUfuUfUfCfaccuaacuauL96 | 210 |
| AD-516827.1 | gsusgaguGfaCfAfAfcguacccuuuL96 | 211 |
| AD-516917.1 | csasagcuCfaGfUfCfuacgccucuuL96 | 212 |
| AD-516973.1 | usgsggagAfgAfUfAfugccuucgauL96 | 213 |
| AD-516978.1 | gsasgauaUfgCfCfUfucgaggauauL96 | 214 |
| AD-517310.1 | gsusggaaUfcUfGfCfcauugcgauuL96 | 215 |
| AD-516828.1 | usgsgagugAfcAfAfCfguacccuuuL96 | 216 |
| AD-517249.1 | csusugcuAfcCfCfAfuuaggauaauL96 | 217 |
| AD-517196.1 | gsusgggauAfcAfUfGfagcaagauuuL96 | 218 |
| AD-517322.1 | asusugcgAfuUfGfUfUfccagagacuuL96 | 219 |
| AD-517319.1 | gscscauuGfcGfAfUfuguccagaguL96 | 220 |
| AD-516822.1 | gsasggagUfgAfGfUfgacaacguauL96 | 221 |
| AD-516826.1 | asgsugagUfgAfCfAfacguacccuuL96 | 222 |
| AD-516824.1 | gsgsagugAfgUfGfAfcaacguaccuL96 | 223 |
| AD-517517.1 | ususgggcAfaUfAfAfaguaccugcuL96 | 224 |
| AD-517758.1 | asusgcguUfaAfUfUfcagcugguuuL96 | 225 |
| AD-516940.1 | csasgggaAfcCfUfCfuaccuucuuL96 | 226 |
| AD-517318.1 | usgsccauUfgCfGfUfauugucagauL96 | 227 |
| AD-517321.1 | csasuugcGfaUfUfGfuccagagacuL96 | 228 |
| AD-516747.1 | csasaagaCfgAfAfGfucguggaugL96 | 229 |
| AD-516737.1 | csusuucgGfuCfCfAfaagacgaaguL96 | 230 |
| AD-516742.1 | csgsgguccAfaAfGfAfAfcgaagucguuL96 | 231 |
| AD-516977.1 | asgsagauAfuGfCfCfuucgaggauuL96 | 232 |
| AD-516823.1 | asgsgaguGfaGfUfGfacaacguacuL96 | 233 |
| AD-516871.1 | asusucugcCfcUfAfAfaguaguucuuL96 | 234 |

TABLE 3-continued

Modified Sense and Antisense Strand Sequences of PNPLA3 dsRNA Agents

| Duplex Name | Sense Sequence 5' to 3' | SEQ ID NO: |
|---|---|---|
| AD-516771.1 | csusucuaCfaGfUfGfgccuuauccuL96 | 235 |
| AD-517757.1 | csasugcgUfuAfAfUfucagcugguuL96 | 236 |
| AD-516745.1 | uscscaaaGfaCfGfAfagucguggauL96 | 237 |
| AD-517830.1 | gsusggccCffuUfUfAfaauggucaguL96 | 238 |
| AD-516970.1 | usgscuggGfaGfAfGfauaugccuuuL96 | 239 |
| AD-517768.1 | uscsagcuGfgUfUfGfggaaaugacuL96 | 240 |
| AD-517259.1 | ususgcuaCfcCfAfUfuaggauauuL96 | 241 |
| AD-516979.1 | asgsauauGfcCfUfUfcgaggauauuL96 | 242 |
| AD-516971.1 | gscsugggAfgAfGfAfuaugccuucuL96 | 243 |
| AD-517838.1 | ususaaugGfuCfAfGfacuguuccauL96 | 244 |
| AD-516743.1 | gsgsuccaAfaGfAfAfCfgaagucguguL96 | 245 |
| AD-516980.1 | gsasauaugCfcUfUfCfgaggauauuL96 | 246 |
| AD-517771.1 | gscsugguUfgGfGfAfaaugacaccuL96 | 247 |
| AD-516772.1 | ususcuacAfgUfGfGfccuuauccuL96 | 248 |
| AD-517836.1 | usasuuaaUfgGfUfCfagacuguucuL96 | 249 |
| AD-516741.1 | ususcgguCfcAfAfAfgacgaagucuL96 | 250 |
| AD-517353.1 | ususccagAfuAfUfGfcccgacgauuL96 | 251 |
| AD-517979.1 | ususuagaAfcAfCfCfuuuuuccuuL96 | 252 |
| AD-516937.1 | gscsacagGfgAfAfCfcucuaccuuuL96 | 253 |
| AD-516976.1 | gsasgagaUfaUfGfCfcuucgaggauL96 | 254 |
| AD-516872.1 | uscsugccCfuAfAfAfaguucaaguccuL96 | 255 |
| AD-517256.1 | csasacuuGfcUfAfCfccauuaggauL96 | 256 |
| AD-516825.1 | gsasgugaGfuGfAfCfaacguaccuL96 | 257 |
| AD-516735.1 | gsascuuuCfgGfUfCfcaaagacgauL96 | 258 |
| AD-516588.1 | gsgsccagGfaGfUfCfggaacauuguL96 | 259 |
| AD-516738.1 | ususucggUfcCfAfAfagacgaaguuL96 | 260 |
| AD-517314.1 | asasucugCfcAfUfUfgcgauugucuL96 | 261 |
| AD-517805.1 | csasgaggGfuCfCfCfuuuacugacuL96 | 262 |
| AD-517685.1 | ususgguuUfaAfUfGfaaaagcuaguL96 | 263 |
| AD-517831.1 | usgsgcccUfaUfUfAfauggucagauL96 | 264 |
| AD-516830.1 | asgsugacAfaCfGfUfaccuucauuL96 | 265 |
| AD-517837.1 | asusuaauGfuGfUfCfagacuguucuL96 | 266 |
| AD-517633.1 | gsusgcagCfuAfCfCfuccgcauuguL96 | 267 |
| AD-516855.1 | gscscaaaAfcAfAfCfcaucaccguuL96 | 268 |
| AD-516688.1 | asascguuCfuGfGfUfgucugacuuuL96 | 269 |
| AD-516630.1 | ususaagcAfaGfUfUfccuccgacauL96 | 270 |

TABLE 3-continued

Modified Sense and Antisense Strand Sequences of PNPLA3 dsRNA Agents

| Duplex Name | Sense Sequence 5' to 3' | SEQ ID NO: |
|---|---|---|
| AD-516835.1 | csasacguAfcCfCfUfucauugauguL96 | 271 |
| AD-516832.1 | usgsacaaCfgUfAfCfccuucauuguL96 | 272 |
| AD-517834.1 | cscscuauUfaAfUfGfgucagacuguL96 | 273 |
| AD-516734.1 | usgsacuuUfcGfGfUfccaaagacguL96 | 274 |
| AD-517228.1 | gsascaaaGfgUfGfGfauacaugaguL96 | 275 |
| AD-516736.1 | ascsuuucGfgUfCfCfaaagacgaauL96 | 276 |
| AD-517646.1 | csgscauuGfcUfGfUfguagugaccuL96 | 277 |
| AD-517744.1 | uscsuaauAfcAfUfCfagcaugcguuL96 | 278 |
| AD-517509.1 | ascsuucuUfcUfUfGfggcauaaauL96 | 279 |
| AD-517746.1 | usasauacAfcUfCfAfGfcaugcguuauL96 | 280 |
| AD-516752.1 | ascsgaagUfcGfUfGfgaugccuuguL96 | 281 |
| AD-516746.1 | cscsaaagAfcGfAfAfgucguggauuL96 | 282 |
| AD-517227.1 | asgsacaaAfgGfUfGfgauacaugauL96 | 283 |
| AD-516751.1 | gsascgaaGfuCfGfUfggaugccuuuL96 | 284 |
| AD-517042.1 | csasuccuCfaGfAfAfgggaugggauuL96 | 285 |
| AD-517571.1 | usgsagucAfcUfUfGfaggaggcgauL96 | 286 |
| AD-517197.1 | asAfsguug(Cgn)aaaucuUfgCfucaugsusa | 287 |
| AD-516851.1 | asUfsgaug(Ggn)uuguuuUfgGfcaucasasu | 288 |
| AD-516748.1 | asGfscauc(Cgn)acgacuUfcGfucuuusgsg | 289 |
| AD-517234.1 | asAfsucuu(Ggn)cucaugUfaUfccaccsusu | 290 |
| AD-517354.1 | asCfsaucg(Tgn)cgggcaUfaUfcuggasasg | 291 |
| AD-517257.1 | asAfsuccu(Agn)augggUfAfgCfaaguusgsc | 292 |
| AD-516739.1 | asCfsgacu(Tgn)cgucuuUfgGfaccgasasa | 293 |
| AD-517258.1 | asUfsaucc(Tgn)aauggUfaGfcaagususg | 294 |
| AD-516629.1 | asGfsucgg(Agn)ggaacuUfgCfuuaagsusu | 295 |
| AD-516972.1 | asCfsgaag(Ggn)cauaucUfcUfcccagscsa | 296 |
| AD-517623.1 | asGfsuagc(Tgn)gcacaaAfgAfugggasasa | 297 |
| AD-516733.1 | asGfsucuu(Tgn)ggaccgAfaAfgucagsasc | 298 |
| AD-517985.1 | asUfsaguu(Agn)ggugaaAfaAfggugususc | 299 |
| AD-516827.1 | asAfsaggg(Tgn)acguugUfcAfcucacsusc | 300 |
| AD-516917.1 | asAfsgagg(Cgn)guagacUfgAfgcuugsgsu | 301 |
| AD-516973.1 | asUfscgaa(Ggn)gcauauCfuCfucccasgsc | 302 |
| AD-516978.1 | asUfsaucc(Tgn)cgaaggCfaUfaucucsusc | 303 |
| AD-517310.1 | asAfsucgc(Agn)auggcaGfaUfuccacsasg | 304 |
| AD-516828.1 | asGfsaagg(Ggn)uacguuGfuCfacucascsu | 305 |
| AD-517249.1 | asUfsauac(Cgn)uaauggGfuAfgcaagsusu | 306 |
| AD-517196.1 | asAfsaucu(Ggn)cucauGfuAfuccacscsu | 307 |

TABLE 3-continued

Modified Sense and Antisense Strand Sequences of PNPLA3 dsRNA Agents

| Duplex Name | Sense Sequence 5' to 3' | SEQ ID NO: |
|---|---|---|
| AD-517322.1 | asAfsgucu(Cgn)uggacaAfuCfgcaausgsg | 308 |
| AD-517319.1 | asCfsucug(Ggn)acaaucGfcAfauggcsasg | 309 |
| AD-516822.1 | asUfsacgu(Tgn)gucacuCfaCfuccucscsa | 310 |
| AD-516826.1 | asAfsgggu(Agn)cguuguCfaCfucacuscsc | 311 |
| AD-516824.1 | asGfsguac(Ggn)uugucaCfuCfacuccsusc | 312 |
| AD-517517.1 | asGfscagg(Tgn)acuuuaUfuGfcccaasgsa | 313 |
| AD-517758.1 | asAfsacca(Ggn)cugaauUfaAfcgcausgsc | 314 |
| AD-516940.1 | asGfsagaa(Ggn)guagagGfuUfcccugsusg | 315 |
| AD-517318.1 | asUfscugg(Agn)caaucgCfaAfuggcasgsa | 316 |
| AD-517321.1 | asGfsucuc(Tgn)ggacaaUfcGfcaausgsc | 317 |
| AD-516747.1 | asCfsaucc(Agn)cgacuuCfgUfcuuugsgsa | 318 |
| AD-516737.1 | asCfsuucg(Tgn)cuuggAfcCfgaaagsusc | 319 |
| AD-516742.1 | asAfscgac(Tgn)ucgucuUfuGfgaccgsasa | 320 |
| AD-516977.1 | asAfsuccu(Cgn)gaaggcAfuAfucucscsc | 321 |
| AD-516823.1 | asGfsuacg(Tgn)ugucacUfcAfcuccuscsc | 322 |
| AD-516871.1 | asGfsacuu(Ggn)acuuuaGfgGfcagausgsu | 323 |
| AD-516771.1 | asGfsgaua(Agn)ggccacUfgUfagaagsgsg | 324 |
| AD-517757.1 | asAfsccag(Cgn)ugaauuAfaCfgcausgscu | 325 |
| AD-516745.1 | asUfsccac(Ggn)acuucgUfcUfuuggascsc | 326 |
| AD-517830.1 | asCfsugac(Cgn)auuaauAfgGfgccacsgsa | 327 |
| AD-516970.1 | asAfsaggc(Agn)uaucucUfcCfcagcascsc | 328 |
| AD-517768.1 | asGfsucau(Tgn)ucccaaCfcAfgcugasasu | 329 |
| AD-517259.1 | asAfsuuau(Cgn)cuaaugGfgUfagcaasgsg | 330 |
| AD-516979.1 | asAfsuauc(Cgn)ucgaagGfcAfuaucuscsu | 331 |
| AD-516971.1 | asGfsaagg(Cgn)auaucuCfcCfcagcsascsc | 332 |
| AD-517838.1 | asUfsggaa(Cgn)agucugAfcCfauuaasusa | 333 |
| AD-516743.1 | asCfsacga(Cgn)uucgucUffUfggaccsgsa | 334 |
| AD-516980.1 | asAfsuauau(Cgn)cucgaaGfgCfauaususcsc | 335 |
| AD-517771.1 | asGfsugu(Cgn)auuuccCfaAfccagcsusg | 336 |
| AD-516772.1 | asGfsggau(Agn)aggccaCfuGfuagaasgsg | 337 |
| AD-517836.1 | asGfsaaca(Ggn)ucgacCfaUfuaauasgsg | 338 |
| AD-516741.1 | asGfsacuu(Cgn)gucuuuGfgAfccgaasasg | 339 |
| AD-517353.1 | asAfsucgu(Cgn)gggcauAfuCfuggaasgsc | 340 |
| AD-517979.1 | asGfsguga(Agn)aaagguGfuUfcuaaasasu | 341 |
| AD-516937.1 | asAfsaggu(Agn)gagguuCfcCfugugcsasg | 342 |
| AD-516976.1 | asUfsccuc(Ggn)aaggcaUfaUfcucucscsc | 343 |

TABLE 3-continued

Modified Sense and Antisense Strand Sequences of PNPLA3 dsRNA Agents

| Duplex Name | Sense Sequence 5' to 3' | SEQ ID NO: |
|---|---|---|
| AD-516872.1 | asGfsgacu(Tgn)gacuuuAfgGfgcagasusg | 344 |
| AD-517256.1 | asUfsccua(Agn)uggguaGfcAfaguugscsa | 345 |
| AD-516825.1 | asGfsggua(Cgn)guugucAfcUfcacucscsu | 346 |
| AD-516735.1 | asUfscguc(Tgn)uuggacCfgAfaagucsasg | 347 |
| AD-516588.1 | asCfsaaug(Tgn)uccgacUfcCfuggccsusu | 348 |
| AD-516738.1 | asAfscuuc(Ggn)ucuuugGfaCfcgaaasgsu | 349 |
| AD-517314.1 | asGfsacaa(Tgn)cgcaauGfgCfagauuscsc | 350 |
| AD-517805.1 | asAfsguca(Ggn)uaagggAfcCfcucugscsa | 351 |
| AD-517685.1 | asCfsuagc(Tgn)uuucauAfaAfaccaascsu | 352 |
| AD-517831.1 | asUfscuga(Cgn)cauuaaUfaGfggccascsg | 353 |
| AD-516830.1 | asAfsugaa(Ggn)gguacgUfuGfucacuscsa | 354 |
| AD-517837.1 | asGfsgaac(Agn)gucugaCfcAfuuaausasg | 355 |
| AD-517633.1 | asCfsaaug(Cgn)ggagguAfgCfugcacsasa | 356 |
| AD-516855.1 | asAfscggu(Ggn)augguuGfuUfuuggcsasu | 357 |
| AD-516688.1 | asAfsaguc(Agn)gacaccAfgAfacguususu | 358 |
| AD-516630.1 | asUfsgucg(Ggn)aggaacUfuGfcuuaasgsu | 359 |
| AD-516835.1 | asCfsauca(Agn)ugaaggGfuAfcguugsusc | 360 |
| AD-516832.1 | asCfsaaug(Agn)agggaaCfgUfugucascsu | 361 |
| AD-517834.1 | asCfsaguc(Tgn)gaccauUfaAfuagggscsc | 362 |
| AD-516734.1 | asCfsgucu(Tgn)uggaccGfaAfagucascsa | 363 |
| AD-517228.1 | asCfsucau(Ggn)uauccaCfcUfuugucsusu | 364 |
| AD-516736.1 | asUfsucgu(Cgn)uuuggaCfcGfaaagusscsa | 365 |
| AD-517646.1 | asGfsguca(Cgn)uacacaGfcAfaugcgsgsa | 366 |
| AD-517744.1 | asAfscgca(Tgn)gcugauGfuAfuuagasgsu | 367 |
| AD-517509.1 | asUfsuuau(Tgn)gcccaaGfaAfgaagususc | 368 |
| AD-517746.1 | asUfsaacg(Cgn)augcugAfuGfuauuasgsa | 369 |
| AD-516752.1 | asCfsaagg(Cgn)auccacGfaCfuuccgsuscsu | 370 |
| AD-516746.1 | asAfsucca(Cgn)gacuucGfuCfuuuggsasc | 371 |
| AD-517227.1 | asUfscaug(Tgn)auccacCfuUfugucusu | 372 |
| AD-516751.1 | asAfsaggc(Agn)uccacgAfcUfucgcsusu | 373 |
| AD-517042.1 | asAfsucca(Tgn)cccuucUfgAfggaugsasc | 374 |
| AD-517571.1 | asUfscgcc(Tgn)ccucaaGfuGfacucascsa | 375 |
| AD-517197.1 | UACAUGAGCAAGAUUUGCAACUU | 376 |
| AD-516851.1 | AUUGAUGCCAAAACAACCAUCAC | 377 |
| AD-516748.1 | CCAAAGACGAAGUCGUGGAUGCC | 378 |
| AD-517234.1 | AAGGUGGAUACAUGAGCAAGAUU | 379 |
| AD-517354.1 | CUUCCAGAUAUGCCCGACGAUGU | 380 |
| AD-517257.1 | GCAACUUGCUACCCAUUAGGAUA | 381 |
| AD-516739.1 | UUUCGGUCCAAAGACGAAGUCGU | 382 |
| AD-517258.1 | CAACUUGCUACCCAUUAGGAUAA | 383 |
| AD-516629.1 | AACUUAAGCAAGUUCCUCCGACA | 384 |
| AD-516972.1 | UGCUGGGAGAGAUAUGCCUUCGA | 385 |
| AD-517623.1 | UUUCCCAUCUUUGUGCAGCUACC | 386 |
| AD-516733.1 | GUCUGACUUUCGGUCCAAAGACG | 387 |
| AD-517985.1 | GAACACCUUUUUCACCUAACUAA | 388 |
| AD-516827.1 | GAGUGAGUGACAACGUACCCUUC | 389 |
| AD-516917.1 | ACCAAGCUCAGUCUACGCCUCUG | 390 |
| AD-516973.1 | GCUGGGAGAGAUAUGCCUUCGAG | 391 |
| AD-516978.1 | GAGAGAUAUGCCUUCGAGGAUAU | 392 |
| AD-517310.1 | CUGUGGAAUCUGCCAUUGCGAUU | 393 |
| AD-516828.1 | AGUGAGUGACAACGUACCCUUCA | 394 |
| AD-517249.1 | AACUUGCUACCCAUUAGGAUAAU | 395 |
| AD-517196.1 | AGGUGGAUACAUGAGCAAGAUUU | 396 |
| AD-517322.1 | CCAUUGCGAUUGUCCAGAGACUG | 397 |
| AD-517319.1 | CUGCCAUUGCGAUUGUCCAGAGA | 398 |
| AD-516822.1 | UGGAGGAGUGAGUGACAACGUAC | 399 |
| AD-516826.1 | GGAGUGAGUGACAACGUACCCUU | 400 |
| AD-516824.1 | GAGGAGUGAGUGACAACGUACCC | 401 |
| AD-517517.1 | UCUUGGGCAAUAAAGUACCUGCU | 402 |
| AD-517758.1 | GCAUGCGUUAAUUCAGCUGGUUG | 403 |
| AD-516940.1 | CACAGGGAACCUCUACCUUCUCU | 404 |
| AD-517318.1 | UCUGCCAUUGCGAUUGUCCAGAG | 405 |
| AD-517321.1 | GCCAUUGCGAUUGUCCAGAGACU | 406 |
| AD-516747.1 | UCCAAAGACGAAGUCGUGGAUGC | 407 |
| AD-516737.1 | GACUUUCGGUCCAAAGACGAAGU | 408 |
| AD-516742.1 | UUCGGUCCAAAGACGAAGUCGUG | 409 |
| AD-516977.1 | GGAGAGAUAUGCCUUCGAGGAUA | 410 |
| AD-516823.1 | GGAGGAGUGAGUGACAACGUACC | 411 |
| AD-516871.1 | ACAUCUGCCCUAAAGUCAAGUCC | 412 |
| AD-516771.1 | CCCUUCUACAGUGGCCUUAUCCC | 413 |
| AD-517757.1 | AGCAUGCGUUAAUUCAGCUGGUU | 414 |
| AD-516745.1 | GGUCCAAAGACGAAGUCGUGGAU | 415 |
| AD-517830.1 | UCGUGGCCCUAUUAAUGGUCAGA | 416 |

TABLE 3-continued

Modified Sense and Antisense Strand Sequences of PNPLA3 dsRNA Agents

| Duplex Name | Sense Sequence 5' to 3' | SEQ ID NO: |
|---|---|---|
| AD-516970.1 | GGUGCUGGGAGAGAUAUGCCUUC | 417 |
| AD-517768.1 | AUUCAGCUGGUUGGGAAAUGACA | 418 |
| AD-517259.1 | ACUUGCUACCCAUUAGGAUAAUG | 419 |
| AD-516979.1 | AGAGAUAUGCCUUCGAGGAUAUU | 420 |
| AD-516971.1 | GUGCUGGGAGAGAUAUGCCUUCG | 421 |
| AD-517838.1 | UAUUAAUGGUCAGACUGUUCCAG | 422 |
| AD-516743.1 | UCGGUCCAAAGACGAAGUCGUGG | 423 |
| AD-516980.1 | GAGAUAUGCCUUCGAGGAUAUUU | 424 |
| AD-517771.1 | CAGCUGGUUGGGAAAUGACACCA | 425 |
| AD-516772.1 | CCUUCUACAGUGGCCUUAUCCCU | 426 |
| AD-517836.1 | CCUAUUAAUGGUCAGACUGUUCC | 427 |
| AD-516741.1 | CUUUCGGUCCAAAGACGAAGUCG | 428 |
| AD-517353.1 | GCUUCCAGAUAUGCCCGACGAUG | 429 |
| AD-517979.1 | AUUUUAGAACACCUUUUUCACCU | 430 |
| AD-516937.1 | CUGCACAGGGAACCUCUACCUUC | 431 |
| AD-516976.1 | GGGAGAGAUAUGCCUUCGAGGAU | 432 |
| AD-516872.1 | CAUCUGCCCUAAAGUCAAGUCCA | 433 |
| AD-517256.1 | UGCAACUUGCUACCCAUUAGGAU | 434 |
| AD-516825.1 | AGGAGUGAGUGACAACGUACCCU | 435 |
| AD-516735.1 | CUGACUUUCGGUCCAAAGACGAA | 436 |
| AD-516588.1 | AAGGCCAGGAGUCGGAACAUUGG | 437 |
| AD-516738.1 | ACUUUCGGUCCAAAGACGAAGUC | 438 |
| AD-517314.1 | GGAAUCUGCCAUUGCGAUUGUCC | 439 |
| AD-517805.1 | UGCAGAGGGUCCCUUACUGACUG | 440 |
| AD-517685.1 | AGUGGUUUUAUGAAAAGCUAGG | 441 |
| AD-517831.1 | CGUGGCCCUAUUAAUGGUCAGAC | 442 |
| AD-516830.1 | UGAGUGACAACGUACCCUUCAUU | 443 |
| AD-517837.1 | CUAUUAAUGGUCAGACUGUUCCA | 444 |
| AD-517633.1 | UUGUGCAGCUACCUCCGCAUUGC | 445 |
| AD-516855.1 | AUGCCAAAACAACCAUCACCGUG | 446 |
| AD-516688.1 | AAAACGUUCUGGGUGUCUGACUUU | 447 |
| AD-516630.1 | ACUUAAGCAAGUUCCUCCGACAG | 448 |
| AD-516835.1 | GACAACGUACCCUUCAUUGAUGC | 449 |
| AD-516832.1 | AGUGACAACGUACCCUUCAUUGA | 450 |
| AD-517834.1 | GGCCCUAUUAAUGGUCAGACUGU | 451 |
| AD-516734.1 | UCUGACUUUCGGUCCAAAGACGA | 452 |
| AD-517228.1 | AAGACAAAGGUGGAUACAUGAGC | 453 |
| AD-516736.1 | UGACUUUCGGUCCAAAGACGAAG | 454 |
| AD-517646.1 | UCCGCAUUGCUGUGUAGUGACCC | 455 |
| AD-517744.1 | ACUCUAAUACAUCAGCAUGCGUU | 456 |
| AD-517509.1 | GAACUUCUUCUUGGGCAAUAAAG | 457 |
| AD-517746.1 | UCUAAUACAUCAGCAUGCGUUAA | 458 |
| AD-516752.1 | AGACGAAGUCGUGGAUGCCUUGG | 459 |
| AD-516746.1 | GUCCAAAGACGAAGUCGUGGAUG | 460 |
| AD-517227.1 | AAAGACAAAGGUGGAUACAUGAG | 461 |
| AD-516751.1 | AAGACGAAGUCGUGGAUGCCUUG | 462 |
| AD-517042.1 | GUCAUCCUCAGAAGGGAUGGAUC | 463 |
| AD-517571.1 | UGUGAGUCACUUGAGGAGGCGAG | 464 |

TABLE 4

Unmodified Sense and Antisense Strand Sequences of PNPLA3 dsRNA Agents

| Duplex Name | Sense Sequence 5' to 3' | SEQ ID NO: | Range in NM_025225.2 |
|---|---|---|---|
| AD-67605.6 | ACCUGUUGAAUUUUGUAUUAU | 465 | 2245-2265 |
| AD-520101.1 | UACCUGUUGAAUUUUGUAUUU | 466 | 2244-2264 |
| AD-520098.1 | GUUGUUACCUGUUGAAUUUUU | 467 | 2239-2259 |
| AD-67575.6 | UUACCUGUUGAAUUUUGUAUU | 468 | 2243-2263 |
| AD-520467.1 | UUGAACCUGGCUUAUUUUCUU | 469 | 2714-2734 |
| AD-520064.1 | CUUUUUCACCUAACUAAAAUU | 470 | 2182-2202 |
| AD-520099.1 | UGUUACCUGUUGAAUUUUGUU | 471 | 2241-2261 |
| AD-520466.1 | CUUGAACCUGGCUUAUUUUCU | 472 | 2713-2733 |
| AD-519351.1 | AGGAUAAUGUCUUAUGUAAUU | 473 | 1218-1238 |
| AD-520065.1 | UUUUUCACCUAACUAAAAUAU | 474 | 2183-2203 |
| AD-520069.1 | CACCUAACUAAAAUAAUGUUU | 475 | 2188-2208 |
| AD-519828.1 | CAUCAGCAUGCGUUAAUUCAU | 476 | 1817-1837 |
| AD-520035.1 | GGUAACAAGAUGAUAAUCUAU | 477 | 2146-2166 |
| AD-520067.1 | UUUCACCUAACUAAAAUAAUU | 478 | 2185-2205 |
| AD-75289.2 | UUCACCUAACUAAAAUAAUGU | 479 | 2186-2206 |
| AD-520125.1 | GUGAGAUGUUAGUAGAAUAAU | 480 | 2274-2294 |
| AD-520018.1 | GAUAACCUUGACUACUAAAAU | 481 | 2110-2130 |
| AD-520062.1 | ACCUUUUUCACCUAACUAAAU | 482 | 2180-2200 |
| AD-519754.1 | GAGCUGAGUUGGUUUUAUGAU | 483 | 1743-1763 |

TABLE 4-continued

Unmodified Sense and Antisense Strand Sequences of PNPLA3 dsRNA Agents

| Duplex Name | Sense Sequence 5' to 3' | SEQ ID NO: | Range in NM_025225.2 |
|---|---|---|---|
| AD-520097.1 | CGUUGUUACCUGUUGAAUUUU | 484 | 2238-2258 |
| AD-520352.1 | UGAGAUUGCACCAUUUCAUUU | 485 | 2544-2564 |
| AD-519755.1 | AGCUGAGUUGGUUUUAUGAAU | 486 | 1744-1764 |
| AD-520063.1 | CCUUUUUCACCUAACUAAAAU | 487 | 2181-2201 |
| AD-520066.1 | UUUUCACCUAACUAAAAUAAU | 488 | 2184-2204 |
| AD-520068.1 | UCACCUAACUAAAAUAAUGUU | 489 | 2187-2207 |
| AD-520465.1 | ACUUGAACCUGGCUUAUUUUU | 490 | 2712-2732 |
| AD-519592.1 | UCUUCUUGGGCAAUAAAGUAU | 491 | 1540-1560 |
| AD-519591.1 | UUCUUCUUGGGCAAUAAAGUU | 492 | 1539-1559 |
| AD-67605.6 | AUAAUACAAAAUUCAACAGGUAA | 493 | 2243-2265 |
| AD-520101.1 | AAAUACAAAAUUCAACAGGUAAC | 494 | 2242-2264 |
| AD-520098.1 | AAAAAUUCAACAGGUAACAACGC | 495 | 2237-2259 |
| AD-67575.6 | AAUACAAAAUUCAACAGGUAACA | 496 | 2241-2263 |
| AD-520467.1 | AAGAAAAUAAGCCAGGUUCAAGU | 497 | 2712-2734 |
| AD-520064.1 | AAUUUUAGUUAGGUGAAAAGGU | 498 | 2180-2202 |
| AD-520099.1 | AACAAAAUUCAACAGGUAACAAC | 499 | 2239-2261 |
| AD-520466.1 | AGAAAAUAAGCCAGGUUCAAGUU | 500 | 2711-2733 |
| AD-519351.1 | AAUUACAUAAGACAUUAUCCUAA | 501 | 1216-1238 |
| AD-520065.1 | AUAUUUUAGUUAGGUGAAAAAGG | 502 | 2181-2203 |
| AD-520069.1 | AAACAUUAUUUUAGUUAGGUGAA | 503 | 2186-2208 |
| AD-519828.1 | AUGAAUUAACGCAUGCUGAUGUA | 504 | 1815-1837 |
| AD-520035.1 | AUAGAUUAUCAUCUUGUUACCCC | 505 | 2144-2166 |
| AD-520067.1 | AAUUAUUUUAGUUAGGUGAAAAA | 506 | 2183-2205 |
| AD-75289.2 | ACAUUAUUUUAGUUAGGUGAAAA | 507 | 2184-2206 |
| AD-520125.1 | AUUAUUCUACUAACAUCUCACUG | 508 | 2272-2294 |
| AD-520018.1 | AUUUUAGUAGUCAAGGUUAUCAU | 509 | 2108-2130 |
| AD-520062.1 | AUUUAGUUAGGUGAAAAAGGUGU | 510 | 2178-2200 |
| AD-519754.1 | AUCAUAAAACCAACUCAGCUCAG | 511 | 1741-1763 |
| AD-520097.1 | AAAAUUCAACAGGUAACAACGCU | 512 | 2236-2258 |
| AD-520352.1 | AAAUGAAAUGGUGCAAUCUCAGC | 513 | 2542-2564 |
| AD-519755.1 | AUUCAUAAAACCAACUCAGCUCA | 514 | 1742-1764 |
| AD-520063.1 | AUUUUAGUUAGGUGAAAAAGGUG | 515 | 2179-2201 |
| AD-520066.1 | AUUAUUUUAGUUAGGUGAAAAAG | 516 | 2182-2204 |
| AD-520068.1 | AACAUUAUUUUAGUUAGGUGAAA | 517 | 2185-2207 |
| AD-520465.1 | AAAAAUAAGCCAGGUUCAAGUUG | 518 | 2710-2732 |
| AD-519592.1 | AUACUUUAUUGCCCAAGAAGAAG | 519 | 1538-1560 |
| AD-519591.1 | AACUUUAUUGCCCAAGAAGAAGU | 520 | 1537-1559 |

TABLE 5

Modified Sense and Antisense Strand Sequences of PNPLA3 dsRNA Agents

| Duplex Name | Sense Sequence 5' to 3' | SEQ ID NO: |
|---|---|---|
| AD-67605.6 | ascscuguUfgAfAfUfuuuguauuauL96 | 521 |
| AD-520101.1 | usasccugUfuGfAfAfuuuuguauuuuL96 | 522 |
| AD-520098.1 | gsusuguuAfcCfUfGfuugaauuuuuL96 | 523 |
| AD-67575.6 | ususaccuGfuUfGfAfauuuuguauuL96 | 524 |
| AD-520467.1 | ususgaacCfuGfGfCfuuauuuucuuL96 | 525 |
| AD-520064.1 | csusuuuuCfaCfCfUfaacuaaaauuL96 | 526 |
| AD-520099.1 | usgsuuacCfuGfUfUfgaauuuuguuL96 | 527 |
| AD-520466.1 | csusugaaCfcUfGfGfcuuauuuucuL96 | 528 |
| AD-519351.1 | asgsgauaAfuGfUfCfuuauguaauuL96 | 529 |
| AD-520065.1 | ususuuucAfcCfUfAfacuaaaauauL96 | 530 |
| AD-520069.1 | csasccuaAfcUfAfAfaauaauguuuL96 | 531 |
| AD-519828.1 | csasucagCfaUfGfCfguuaauucauL96 | 532 |

TABLE 5-continued

Modified Sense and Antisense Strand Sequences of PNPLA3 dsRNA Agents

| | | |
|---|---|---|
| AD-520035.1 | gsgsuaacAfaGfAfUfgauaaucuauL96 | 533 |
| AD-520067.1 | ususucacCfuAfAfCfuaaaauaauuL96 | 534 |
| AD-75289.2 | ususcaccUfaAfCfUfaaaauaauguL96 | 535 |
| AD-520125.1 | gsusgagaUfgUfUfAfguagaauaauL96 | 536 |
| AD-520018.1 | gsasuaacCfuUfGfAfcuacuaaaauL96 | 537 |
| AD-520062.1 | ascscuuuUfuCfAfCfcuaacuaaauL96 | 538 |
| AD-519754.1 | gsasgcugAfgUfUfGfguuuuaugauL96 | 539 |
| AD-520097.1 | csgsuuguUfaCfCfUfguugaauuuuL96 | 540 |
| AD-520352.1 | usgsagauUfgCfAfCfcauuucauuuL96 | 541 |
| AD-519755.1 | asgscugaGfuUfGfGfuuuuaugaauL96 | 542 |
| AD-520063.1 | cscsuuuuUfcAfCfCfuaacuaaaauL96 | 543 |
| AD-520066.1 | ususuucaCfcUfAfAfcuaaaauaauL96 | 544 |
| AD-520068.1 | uscsaccuAfaCfUfAfaaauaauguuL96 | 545 |
| AD-520465.1 | ascsuugaAfcCfUfGfgcuuauuuuuL96 | 546 |
| AD-519592.1 | uscsuucuUfgGfGfCfaauaaaguauL96 | 547 |
| AD-519591.1 | ususcuucUfuGfGfGfcaauaaaguuL96 | 548 |

| Duplex Name | Antisense Sequence 5' to 3' | SEQ ID NO: |
|---|---|---|
| AD-67605.6 | asUfsaauAfcAfAfaauuCfaAfcaggusasa | 549 |
| AD-520101.1 | asAfsauaCfaAfAfauucAfaCfagguasasc | 550 |
| AD-520098.1 | asAfsaaaUfuCfAfacagGfuAfacaacsgsc | 551 |
| AD-67575.6 | asAfsuacAfaAfAfuucaAfcAfgguaascsa | 552 |
| AD-520467.1 | asAfsgaaAfaUfAfagccAfgGfuucaasgsu | 553 |
| AD-520064.1 | asAfsuuuUfaGfUfuaggUfgAfaaaagsgsu | 554 |
| AD-520099.1 | asAfscaaAfaUfUfcaacAfgGfuaacasasc | 555 |
| AD-520466.1 | asGfsaaaAfuAfAfgccaGfgUfucaagsusu | 556 |
| AD-519351.1 | asAfsuuaCfaUfAfagacAfuUfauccusasa | 557 |
| AD-520065.1 | asUfsauuUfuAfGfuuagGfuGfaaaaasgsg | 558 |
| AD-520069.1 | asAfsacaUfuAfUfuuuaGfuUfaggugsasa | 559 |
| AD-519828.1 | asUfsgaaUfuAfAfcgcaUfgCfugaugsusa | 560 |
| AD-520035.1 | asUfsagaUfuAfUfucaucUfuGfuuaccscsc | 561 |
| AD-520067.1 | asAfsuuaUfuUfUfaguuAfgGfugaaasasa | 562 |
| AD-75289.2 | asCfsauuAfuUfUfuaguUfaGfugaasasa | 563 |
| AD-520125.1 | asUfsuauUfcUfAfcuaaCfaUfcucacsusg | 564 |
| AD-520018.1 | asUfsuuuAfgUfAfgucaAfgGfuuaucsasu | 565 |
| AD-520062.1 | asUfsuuaGfuUfAfggugAfaAfaaggusgsu | 566 |
| AD-519754.1 | asUfscauAfaAfAfccaaCfuCfagcucsasg | 567 |
| AD-520097.1 | asAfsaauUfcAfAfcaggUfaAfcaacgscsu | 568 |
| AD-520352.1 | asAfsaugAfaAfUfggugCfaAfucucasgsc | 569 |

TABLE 5-continued

Modified Sense and Antisense Strand Sequences of PNPLA3 dsRNA Agents

| | | |
|---|---|---|
| AD-519755.1 | asUfsucaUfaAfAfaccaAfcUfcagcuscsa | 570 |
| AD-520063.1 | asUfsuuuAfgUfUfagguGfaAfaaaggsusg | 571 |
| AD-520066.1 | asUfsuauUfuUfAfguuaGfgUfgaaaasasg | 572 |
| AD-520068.1 | asAfscauUfaUfUfuuagUfuAfggugasasa | 573 |
| AD-520465.1 | asAfsaaaUfaAfGfccagGfuUfcaagususg | 574 |
| AD-519592.1 | asUfsacuUfuAfUfugccCfaAfgaagasasg | 575 |
| AD-519591.1 | asAfscuuUfaUfUfgcccAfaGfaagaasgsu | 576 |

| Duplex Name | mRNA Target Sequence 5' to 3' | SEQ ID NO: |
|---|---|---|
| AD-67605.6 | UUACCUGUUGAAUUUGUAUUAU | 577 |
| AD-520101.1 | GUUACCUGUUGAAUUUGUAUUA | 578 |
| AD-520098.1 | GCGUUGUUACCUGUUGAAUUUG | 579 |
| AD-67575.6 | UGUUACCUGUUGAAUUUGUAUU | 580 |
| AD-520467.1 | ACUUGAACCUGGCUUAUUUUCUG | 581 |
| AD-520064.1 | ACCUUUUUCACCUAACUAAAAUA | 582 |
| AD-520099.1 | GUUGUUACCUGUUGAAUUUUGUA | 583 |
| AD-520466.1 | AACUUGAACCUGGCUUAUUUUCU | 584 |
| AD-519351.1 | UUAGGAUAAUGUCUUAUGUAAUG | 585 |
| AD-520065.1 | CCUUUUUCACCUAACUAAAAUAA | 586 |
| AD-520069.1 | UUCACCUAACUAAAAUAAUGUUU | 587 |
| AD-519828.1 | UACAUCAGCAUGCGUUAAUUCAG | 588 |
| AD-520035.1 | GGGGUAACAAGAUGAUAAUCUAC | 589 |
| AD-520067.1 | UUUUUCACCUAACUAAAAUAAUG | 590 |
| AD-75289.2 | UUUUCACCUAACUAAAAUAAUGU | 591 |
| AD-520125.1 | CAGUGAGAUGUUAGUAGAAUAAG | 592 |
| AD-520018.1 | AUGAUAACCUUGACUACUAAAAA | 593 |
| AD-520062.1 | ACACCUUUUUCACCUAACUAAAA | 594 |
| AD-519754.1 | CUGAGCUGAGUUGGUUUUAUGAA | 595 |
| AD-520097.1 | AGCGUUGUUACCUGUUGAAUUUU | 596 |
| AD-520352.1 | GCUGAGAUUGCACCAUUUCAUUC | 597 |
| AD-519755.1 | UGAGCUGAGUUGGUUUUAUGAAA | 598 |
| AD-520063.1 | CACCUUUUUCACCUAACUAAAAU | 599 |
| AD-520066.1 | CUUUUUCACCUAACUAAAAUAAU | 600 |
| AD-520068.1 | UUUCACCUAACUAAAAUAAUGUU | 601 |
| AD-520465.1 | CAACUUGAACCUGGCUUAUUUUC | 602 |
| AD-519592.1 | CUUCUUCUUGGGCAAUAAAGUAC | 603 |
| AD-519591.1 | ACUUCUUCUUGGGCAAUAAAGUA | 604 |

TABLE 6

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-521420.1 | GGAUAAUGUCUUAUGUAAU | 605 | 1219-1237 | AUUACAUAAGACAUUAUCC | 712 | 1219-1237 |
| AD-520973.1 | GAGUGAGUGACAACGUACU | 606 | 676-694 | AGUACGUUGUCACUCACUC | 713 | 676-694 |
| AD-521124.1 | GGAGAGAUAUGCCUUCGAU | 607 | 876-894 | AUCGAAGGCAUAUCUCUCC | 714 | 876-894 |
| AD-521486.1 | UGGUGACAUGGCUUCCAGU | 608 | 1288-1306 | ACUGGAAGCCAUGUCACCA | 715 | 1288-1306 |
| AD-520903.1 | GAAGUCGUGGAUGCCUUGU | 609 | 582-600 | ACAAGGCAUCCACGACUUC | 716 | 582-600 |
| AD-520972.1 | GGAGUGAGUGACAACGUAU | 610 | 675-693 | AUACGUUGUCACUCACUCC | 717 | 675-693 |
| AD-521421.1 | GAUAAUGUCUUAUGUAAUU | 611 | 1220-1238 | AAUUACAUAAGACAUUAUC | 718 | 1220-1238 |
| AD-521840.1 | GGUUUUAUGAAAAGCUAGU | 612 | 1753-1771 | ACUAGCUUUUCAUAAAACC | 719 | 1753-1771 |
| AD-521003.1 | CAAAACAACCAUCACCGUU | 613 | 707-725 | AACGGUGAUGGUUGUUUUG | 720 | 707-725 |
| AD-521129.1 | GAUAUGCCUUCGAGGAUAU | 614 | 881-899 | AUAUCCUCGAAGGCAUAUC | 721 | 881-899 |
| AD-521465.1 | CCAUUGCGAUUGUCCAGAU | 615 | 1267-1285 | AUCUGGACAAUCGCAAUGG | 722 | 1267-1285 |
| AD-521086.1 | ACAGGGAACCUCUACCUUU | 616 | 819-837 | AAAGGUAGAGGUUCCCUGU | 723 | 819-837 |
| AD-521409.1 | UGCUACCCAUUAGGAUAAU | 617 | 1207-1225 | AUUAUCCUAAUGGGUAGCA | 724 | 1207-1225 |
| AD-522178.1 | CCUGUUGAAUUUUGUAUUU | 618 | 2246-2264 | AAAUACAAAAUUCAACAGG | 725 | 2246-2264 |
| AD-520974.1 | AGUGAGUGACAACGUACCU | 619 | 677-695 | AGGUACGUUGUCACUCACU | 726 | 677-695 |
| AD-520902.1 | CGAAGUCGUGGAUGCCUUU | 620 | 581-599 | AAAGGCAUCCACGACUUCG | 727 | 581-599 |
| AD-522140.1 | CUUUUUCACCUAACUAAAU | 621 | 2182-2200 | AUUUAGUUAGGUGAAAAAG | 728 | 2182-2200 |
| AD-521410.1 | GCUACCCAUUAGGAUAAUU | 622 | 1208-1226 | AAUUAUCCUAAUGGGUAGC | 729 | 1208-1226 |
| AD-522548.1 | GAACCUGGCUUAUUUUCUU | 623 | 2716-2734 | AAGAAAAUAAGCCAGGUUC | 730 | 2716-2734 |
| AD-521002.1 | CCAAAACAACCAUCACCGU | 624 | 706-724 | ACGGUGAUGGUUGUUUUGG | 731 | 706-724 |
| AD-522176.1 | UUACCUGUUGAAUUUUGUU | 625 | 2243-2261 | AACAAAAUUCAACAGGUAA | 732 | 2243-2261 |
| AD-520926.1 | CUACAGUGGCCUUAUCCCU | 626 | 623-641 | AGGGAUAAGGCCACUGUAG | 733 | 623-641 |
| AD-521895.1 | CUAAUACAUCAGCAUGCGU | 627 | 1811-1829 | ACGCAUGCUGAUGUAUUAG | 734 | 1811-1829 |
| AD-521499.1 | CCAGAUAUGCCCGACGAUU | 628 | 1302-1320 | AAUCGUCGGGCAUAUCUGG | 735 | 1302-1320 |
| AD-521466.1 | CAUUGCGAUUGUCCAGAGU | 629 | 1268-1286 | ACUCUGGACAAUCGCAAUG | 736 | 1268-1286 |
| AD-521140.1 | GAGGAUAUUUGGAUGCAUU | 630 | 892-910 | AAUGCAUCCAAAUAUCCUC | 737 | 892-910 |
| AD-520892.1 | GGUCCAAAGACGAAGUCGU | 631 | 571-589 | ACGACUUCGUCUUUGGACC | 738 | 571-589 |
| AD-520976.1 | UGAGUGACAACGUACCCUU | 632 | 679-697 | AAGGGUACGUUGUCACUCA | 739 | 679-697 |
| AD-521457.1 | GGAAUCUGCCAUUGCGAUU | 633 | 1259-1277 | AAUCGCAAUGGCAGAUUCC | 740 | 1259-1277 |
| AD-521127.1 | GAGAUAUGCCUUCGAGGAU | 634 | 879-897 | AUCCUCGAAGGCAUAUCUC | 741 | 879-897 |
| AD-522145.1 | UCACCUAACUAAAAUAAUU | 635 | 2187-2205 | AAUUAUUUUAGUUAGGUGA | 742 | 2187-2205 |
| AD-520984.1 | ACGUACCCUUCAUUGAUGU | 636 | 688-706 | ACAUCAAUGAAGGGUACGU | 743 | 688-706 |
| AD-521997.1 | CUGUUCCAGCAUGAGGUUU | 637 | 1916-1934 | AAACCUCAUGCUGGAACAG | 744 | 1916-1934 |
| AD-522174.1 | UGUUACCUGUUGAAUUUUU | 638 | 2241-2259 | AAAAAUUCAACAGGUAACA | 745 | 2241-2259 |
| AD-522545.1 | UUGAACCUGGCUUAUUUUU | 639 | 2714-2732 | AAAAAUAAGCCAGGUUCAA | 746 | 2714-2732 |
| AD-521979.1 | GGCCCUAUUAAUGGUCAGU | 640 | 1897-1915 | ACUGACCAUUAAUAGGGCC | 747 | 1897-1915 |
| AD-520891.1 | CGGUCCAAAGACGAAGUCU | 641 | 570-588 | AGACUUCGUCUUUGGACCG | 748 | 570-588 |

TABLE 6-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-521833.1 | CUGAGUUGGUUUUAUGAAU | 642 | 1746-1764 | AUUCAUAAAACCAACUCAG | 749 | 1746-1764 |
| AD-521461.1 | UCUGCCAUUGCGAUUGUCU | 643 | 1263-1281 | AGACAAUCGCAAUGGCAGA | 750 | 1263-1281 |
| AD-521386.1 | GGAUACAUGAGCAAGAUUU | 644 | 1182-1200 | AAAUCUUGCUCAUGUAUCC | 751 | 1182-1200 |
| AD-521123.1 | GGGAGAGAUAUGCCUUCGU | 645 | 875-893 | ACGAAGGCAUAUCUCUCCC | 752 | 875-893 |
| AD-520899.1 | AGACGAAGUCGUGGAUGCU | 646 | 578-596 | AGCAUCCACGACUUCGUCU | 753 | 578-596 |
| AD-521089.1 | GGGAACCUCUACCUUCUCU | 647 | 822-840 | AGAGAAGGUAGAGGUUCCC | 754 | 822-840 |
| AD-521407.1 | CUUGCUACCCAUUAGGAUU | 648 | 1205-1223 | AAUCCUAAUGGGUAGCAAG | 755 | 1205-1223 |
| AD-520898.1 | AAGACGAAGUCGUGGAUGU | 649 | 577-595 | ACAUCCACGACUUCGUCUU | 756 | 577-595 |
| AD-521378.1 | ACAAAGGUGGAUACAUGAU | 650 | 1174-1192 | AUCAUGUAUCCACCUUUGU | 757 | 1174-1192 |
| AD-521500.1 | CAGAUAUGCCCGACGAUGU | 651 | 1303-1321 | ACAUCGUCGGGCAUAUCUG | 758 | 1303-1321 |
| AD-521798.1 | CAUUGCUGUGUAGUGACCU | 652 | 1694-1712 | AGGUCACUACACAGCAAUG | 759 | 1694-1712 |
| AD-521902.1 | UCAGCAUGCGUUAAUUCAU | 653 | 1819-1837 | AUGAAUUAACGCAUGCUGA | 760 | 1819-1837 |
| AD-521896.1 | UAAUACAUCAGCAUGCGUU | 654 | 1812-1830 | AACGCAUGCUGAUGUAUUA | 761 | 1812-1830 |
| AD-521989.1 | AUGGUCAGACUGUUCCAGU | 655 | 1907-1925 | ACUGGAACAGUCUGACCAU | 762 | 1907-1925 |
| AD-520896.1 | CAAAGACGAAGUCGUGGAU | 656 | 575-593 | AUCCACGACUUCGUCUUUG | 763 | 575-593 |
| AD-69024.2 | CCUAACUAAAAUAAUGUUU | 657 | 2190-2208 | AAACAUUAUUUUAGUUAGG | 764 | 2190-2208 |
| AD-522146.1 | CACCUAACUAAAAUAAUGU | 658 | 2188-2206 | ACAUUAUUUUAGUUAGGUG | 765 | 2188-2206 |
| AD-522432.1 | AGAUUGCACCAUUUCAUUU | 659 | 2546-2564 | AAAUGAAAUGGUGCAAUCU | 766 | 2546-2564 |
| AD-521020.1 | CUGCCCUAAAGUCAAGUCU | 660 | 752-770 | AGACUUGACUUUAGGGCAG | 767 | 752-770 |
| AD-521668.1 | CUUCUUGGGCAAUAAAGUU | 661 | 1541-1559 | AACUUUAUUGCCCAAGAAG | 768 | 1541-1559 |
| AD-522097.1 | UAACCUUGACUACUAAAAU | 662 | 2112-2130 | AUUUUAGUAGUCAAGGUUA | 769 | 2112-2130 |
| AD-520999.1 | AUGCCAAAACAACCAUCAU | 663 | 703-721 | AUGAUGGUUGUUUUGGCAU | 770 | 703-721 |
| AD-521832.1 | GCUGAGUUGGUUUUAUGAU | 664 | 1745-1763 | AUCAUAAAACCAACUCAGC | 771 | 1745-1763 |
| AD-520894.1 | UCCAAAGACGAAGUCGUGU | 665 | 573-591 | ACACGACUUCGUCUUUGGA | 772 | 573-591 |
| AD-522144.1 | UUCACCUAACUAAAAUAAU | 666 | 2186-2204 | AUUAUUUUAGUUAGGUGAA | 773 | 2186-2204 |
| AD-521408.1 | UUGCUACCCAUUAGGAUAU | 667 | 1206-1224 | AUAUCCUAAUGGGUAGCAA | 774 | 1206-1224 |
| AD-521128.1 | AGAUAUGCCUUCGAGGAUU | 668 | 880-898 | AAUCCUCGAAGGCAUAUCU | 775 | 880-898 |
| AD-521980.1 | GCCCUAUUAAUGGUCAGAU | 669 | 1898-1916 | AUCUGACCAUUAAUAGGGC | 776 | 1898-1916 |
| AD-521406.1 | ACUUGCUACCCAUUAGGAU | 670 | 1204-1222 | AUCCUAAUGGGUAGCAAGU | 777 | 1204-1222 |
| AD-521131.1 | UAUGCCUUCGAGGAUAUUU | 671 | 883-901 | AAAUAUCCUCGAAGGCAUA | 778 | 883-901 |
| AD-521909.1 | GCGUUAAUUCAGCUGGUUU | 672 | 1826-1844 | AAACCAGCUGAAUUAACGC | 779 | 1826-1844 |
| AD-521954.1 | GAGGGUCCCUUACUGACUU | 673 | 1872-1890 | AAGUCAGUAAGGGACCCUC | 780 | 1872-1890 |
| AD-520872.1 | CGUUCUGGUGUCUGACUUU | 674 | 551-569 | AAAGUCAGACACCAGAACG | 781 | 551-569 |
| AD-522142.1 | UUUUCACCUAACUAAAAUU | 675 | 2184-2202 | AAUUUUAGUUAGGUGAAAA | 782 | 2184-2202 |
| AD-520994.1 | CAUUGAUGCCAAAACAACU | 676 | 698-716 | AGUUGUUUUGGCAUCAAUG | 783 | 698-716 |
| AD-520886.1 | ACUUUCGGUCCAAAGACGU | 677 | 565-583 | ACGUCUUUGGACCGAAAGU | 784 | 565-583 |
| AD-521987.1 | UAAUGGUCAGACUGUUCCU | 678 | 1905-1923 | AGGAACAGUCUGACCAUUA | 785 | 1905-1923 |

TABLE 6-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
| --- | --- | --- | --- | --- | --- | --- |
| AD-521988.1 | AAUGGUCAGACUGUUCCAU | 679 | 1906-1924 | AUGGAACAGUCUGACCAUU | 786 | 1906-1924 |
| AD-520785.1 | AAGCAAGUUCCUCCGACAU | 680 | 443-461 | AUGUCGGAGGAACUUGCUU | 787 | 443-461 |
| AD-521919.1 | AGCUGGUUGGGAAAUGACU | 681 | 1836-1854 | AGUCAUUUCCCAACCAGCU | 788 | 1836-1854 |
| AD-521121.1 | CUGGGAGAGAUAUGCCUUU | 682 | 873-891 | AAAGGCAUAUCUCUCCCAG | 789 | 873-891 |
| AD-522202.1 | GAGAUGUUAGUAGAAUAAU | 683 | 2276-2294 | AUUAUUCUACUAACAUCUC | 790 | 2276-2294 |
| AD-521130.1 | AUAUGCCUUCGAGGAUAUU | 684 | 882-900 | AAUAUCCUCGAAGGCAUAU | 791 | 882-900 |
| AD-521908.1 | UGCGUUAAUUCAGCUGGUU | 685 | 1825-1843 | AACCAGCUGAAUUAACGCA | 792 | 1825-1843 |
| AD-522173.1 | UUGUUACCUGUUGAAUUUU | 686 | 2240-2258 | AAAAUUCAACAGGUAACAA | 793 | 2240-2258 |
| AD-521785.1 | GCAGCUACCUCCGCAUUGU | 687 | 1681-1699 | ACAAUGCGGAGGUAGCUGC | 794 | 1681-1699 |
| AD-520890.1 | UCGGUCCAAAGACGAAGUU | 688 | 569-587 | AACUUCGUCUUUGGACCGA | 795 | 569-587 |
| AD-520978.1 | AGUGACAACGUACCCUUCU | 689 | 681-699 | AGAAGGGUACGUUGUCACU | 796 | 681-699 |
| AD-521744.1 | GUCUAGCAGAUUCUUUCAU | 690 | 1637-1655 | AUGAAAGAAUCUGCUAGAC | 797 | 1637-1655 |
| AD-521021.1 | UGCCCUAAAGUCAAGUCCU | 691 | 753-771 | AGGACUUGACUUUAGGGCA | 798 | 753-771 |
| AD-521197.1 | UCCUCAGAAGGGAUGGAUU | 692 | 966-984 | AAUCCAUCCCUUCUGAGGA | 799 | 966-984 |
| AD-521379.1 | CAAAGGUGGAUACAUGAGU | 693 | 1175-1193 | ACUCAUGUAUCCACCUUUG | 800 | 1175-1193 |
| AD-520925.1 | UCUACAGUGGCCUUAUCCU | 694 | 622-640 | AGGAUAAGGCCACUGUAGA | 801 | 622-640 |
| AD-520888.1 | UUUCGGUCCAAAGACGAAU | 695 | 567-585 | AUUCGUCUUUGGACCGAAA | 802 | 567-585 |
| AD-520975.1 | GUGAGUGACAACGUACCCU | 696 | 678-696 | AGGGUACGUUGUCACUCAC | 803 | 678-696 |
| AD-521666.1 | UUCUUCUUGGGCAAUAAAU | 697 | 1539-1557 | AUUUAUUGCCCAAGAAGAA | 804 | 1539-1557 |
| AD-521922.1 | UGGUUGGGAAAUGACACCU | 698 | 1839-1857 | AGGUGUCAUUUCCCAACCA | 805 | 1839-1857 |
| AD-521986.1 | UUAAUGGUCAGACUGUUCU | 699 | 1904-1922 | AGAACAGUCUGACCAUUAA | 806 | 1904-1922 |
| AD-521915.1 | AUUCAGCUGGUUGGGAAAU | 700 | 1832-1850 | AUUUCCCAACCAGCUGAAU | 807 | 1832-1850 |
| AD-520897.1 | AAAGACGAAGUCGUGGAUU | 701 | 576-594 | AAUCCACGACUUCGUCUUU | 808 | 576-594 |
| AD-520889.1 | UUCGGUCCAAAGACGAAGU | 702 | 568-586 | ACUUCGUCUUUGGACCGAA | 809 | 568-586 |
| AD-520885.1 | GACUUUCGGUCCAAAGACU | 703 | 564-582 | AGUCUUUGGACCGAAAGUC | 810 | 564-582 |
| AD-521469.1 | UGCGAUUGUCCAGAGACUU | 704 | 1271-1289 | AAGUCUCUGGACAAUCGCA | 811 | 1271-1289 |
| AD-521674.1 | GGGCAAUAAAGUACCUGCU | 705 | 1547-1565 | AGCAGGUACUUUAUUGCCC | 812 | 1547-1565 |
| AD-521983.1 | CUAUUAAUGGUCAGACUGU | 706 | 1901-1919 | ACAGUCUGACCAUUAAUAG | 813 | 1901-1919 |
| AD-521385.1 | UGGAUACAUGAGCAAGAUU | 707 | 1181-1199 | AAUCUUGCUCAUGUAUCCA | 814 | 1181-1199 |
| AD-521937.1 | ACCAGGAAGCCCAGUGCAU | 708 | 1854-1872 | AUGCACUGGGCUUCCUGGU | 815 | 1854-1872 |
| AD-522141.1 | UUUUUCACCUAACUAAAAU | 709 | 2183-2201 | AUUUUAGUUAGGUGAAAAA | 816 | 2183-2201 |
| AD-522143.1 | UUUCACCUAACUAAAAUAU | 710 | 2185-2203 | AUAUUUUAGUUAGGUGAAA | 817 | 2185-2203 |
| AD-521669.1 | UUCUUGGGCAAUAAAGUAU | 711 | 1542-1560 | AUACUUUAUUGCCCAAGAA | 818 | 1542-1560 |

TABLE 7

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-521420.1 | GGAUAAUGUCUUAUGUAAUdTdT | 819 | AUUACAUAAGACAUUAUCCdTdT | 926 | GGAUAAUGUCUUAUGUAAU | 1033 |
| AD-520973.1 | GAGUGAGUGACAACGUACCdTdT | 820 | AGUACGUUGUCACUCACUCdTdT | 927 | GAGUGAGUGACAACGUACC | 1034 |
| AD-521124.1 | GGAGAGAUAUGCCUUCGAGdTdT | 821 | AUCGAAGGCAUAUCUCUCCdTdT | 928 | GGAGAGAUAUGCCUUCGAG | 1035 |
| AD-521486.1 | UGGUGACAUGGCUUCCAGAdTdT | 822 | ACUGGAAGCCAUGUCACCAdTdT | 929 | UGGUGACAUGGCUUCCAGA | 1036 |
| AD-520903.1 | GAAGUCGUGGAUGCCUUGGdTdT | 823 | ACAAGGCAUCCACGACUUCdTdT | 930 | GAAGUCGUGGAUGCCUUGG | 1037 |
| AD-520972.1 | GGAGUGAGUGACAACGUACdTdT | 824 | AUACGUUGUCACUCACUCCdTdT | 931 | GGAGUGAGUGACAACGUAC | 1038 |
| AD-521421.1 | GAUAAUGUCUUAUGUAAUGdTdT | 825 | AAUUACAUAAGACAUUAUCdTdT | 932 | GAUAAUGUCUUAUGUAAUG | 1039 |
| AD-521840.1 | GGUUUAUGAAAAGCUAGGdTdT | 826 | ACUAGCUUUUCAUAAAACCdTdT | 933 | GGUUUAUGAAAAGCUAGG | 1040 |
| AD-521003.1 | CAAAACAACCAUCACCGUGdTdT | 827 | AACGGUGAUGGUUGUUUUGdTdT | 934 | CAAAACAACCAUCACCGUG | 1041 |
| AD-521129.1 | GAUAUGCCUUCGAGGAUAUdTdT | 828 | AUAUCCUCGAAGGCAUAUCdTdT | 935 | GAUAUGCCUUCGAGGAUAU | 1042 |
| AD-521465.1 | CCAUUGCGAUUGUCCAGAGdTdT | 829 | AUCUGGACAAUCGCAAUGGdTdT | 936 | CCAUUGCGAUUGUCCAGAG | 1043 |
| AD-521086.1 | ACAGGGAACCUCUACCUUCdTdT | 830 | AAAGGUAGAGGUUCCCUGUdTdT | 937 | ACAGGGAACCUCUACCUUC | 1044 |
| AD-521409.1 | UGCUACCCAUUAGGAUAAUdTdT | 831 | AUUAUCCUAAUGGGUAGCAdTdT | 938 | UGCUACCCAUUAGGAUAAU | 1045 |
| AD-522178.1 | CCUGUUGAAUUUGUAUUAdTdT | 832 | AAAUACAAAAUUCAACAGGdTdT | 939 | CCUGUUGAAUUUGUAUUA | 1046 |
| AD-520974.1 | AGUGAGUGACAACGUACCUdTdT | 833 | AGGUACGUUGUCACUCACUdTdT | 940 | AGUGAGUGACAACGUACCC | 1047 |
| AD-520902.1 | CGAAGUCGUGGAUGCCUUGdTdT | 834 | AAAGGCAUCCACGACUUCGdTdT | 941 | CGAAGUCGUGGAUGCCUUG | 1048 |
| AD-522140.1 | CUUUUCACCUAACUAAAdTdT | 835 | AUUUAGUUAGGUGAAAAAGdTdT | 942 | CUUUUCACCUAACUAAAA | 1049 |
| AD-521410.1 | GCUACCCAUUAGGAUAAUGdTdT | 836 | AAUUAUCCUAAUGGGUAGCdTdT | 943 | GCUACCCAUUAGGAUAAUG | 1050 |
| AD-522548.1 | GAACCUGGCCUUAUUUUCUGdTdT | 837 | AAGAAAAUAAGCCAGGUUCdTdT | 944 | GAACCUGGCCUUAUUUUCUG | 1051 |
| AD-521002.1 | CCAAAACAACCAUCACCGUdTdT | 838 | ACGGUGAUGGUUGUUUUGGdTdT | 945 | CCAAAACAACCAUCACCGU | 1052 |
| AD-521176.1 | UUACCGUUGAAUUUGAAUUGUAdTdT | 839 | AACAAAAUUCAACAGGUAAdTdT | 946 | UUACCGUUGAAUUUGAAUUGUA | 1053 |
| AD-520926.1 | CUACAGUGGCCUUAUCCCUdTdT | 840 | AGGGAUAAGGCCACUGUAGdTdT | 947 | CUACAGUGGCCUUAUCCCU | 1054 |
| AD-521895.1 | CUAAUACAUCAGCAUGCGUdTdT | 841 | ACGCAUGCUGAUGUAUUAGdTdT | 948 | CUAAUACAUCAGCAUGCGU | 1055 |

TABLE 7-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-521499.1 | CCAGAUAUGCCCGACGAUGdTdT | 842 | AAUCGUCGGGCAUAUCUGGdTdT | 949 | CCAGAUAUGCCCGACGAUG | 1056 |
| AD-521466.1 | CAUUGCGAUUGUCCAGAGUdTdT | 843 | ACUCUGGACAAUCGCAAUGdTdT | 950 | CAUUGCGAUUGUCCAGAGA | 1057 |
| AD-521140.1 | GAGGAUAUUUGGAUGCAUUdTdT | 844 | AAUGCAUCCAAAUAUCCUCdTdT | 951 | GAGGAUAUUUGGAUGCAUU | 1058 |
| AD-520892.1 | GGUCCAAAGACGAAGUCGUdTdT | 845 | ACGACUUCGUCUUUGGACCdTdT | 952 | GGUCCAAAGACGAAGUCGU | 1059 |
| AD-520976.1 | UGAGUGACAACGUACCCUUdTdT | 846 | AAGGGUACGUUGUCACUCAdTdT | 953 | UGAGUGACAACGUACCCUU | 1060 |
| AD-521457.1 | GGAAUCUGCCAUUGCGAUUdTdT | 847 | AAUCGCAAUGGCAGAUUCCdTdT | 954 | GGAAUCUGCCAUUGCGAUU | 1061 |
| AD-521127.1 | GAGAUAUGCCUUCGAGGAUdTdT | 848 | AUCCUCGAAGGCAUAUCUCdTdT | 955 | GAGAUAUGCCUUCGAGGAU | 1062 |
| AD-522145.1 | UCACCUAACUAAAAUAAUGdTdT | 849 | AAUUAUUUUAGUUAGGUGAdTdT | 956 | UCACCUAACUAAAAUAAUG | 1063 |
| AD-520984.1 | ACGUACCCUUCAUUGAUGCdTdT | 850 | ACAUCAAUGAAGGGUACGUdTdT | 957 | ACGUACCCUUCAUUGAUGC | 1064 |
| AD-521997.1 | CUGUUCCAGCAUGAGAGUUCdTdT | 851 | AAACUCUCAUGCUGGAACAGdTdT | 958 | CUGUUCCAGCAUGAGAGUUC | 1065 |
| AD-521174.1 | UGUUACCUGGCUUAUUUUGdTdT | 852 | AAAAAAUUCAACAGGUAACAdTdT | 959 | UGUUACCUGGCUUAUUUUG | 1066 |
| AD-522545.1 | UUGAACCUGGCUUAUUUUCdTdT | 853 | AAAAAUAAGCCAGGUUCAAdTdT | 960 | UUGAACCUGGCUUAUUUUC | 1067 |
| AD-521979.1 | GGCCCUAUUAAUGGUCAGAdTdT | 854 | ACUGACCAUUAAUAGGGCCdTdT | 961 | GGCCCUAUUAAUGGUCAGA | 1068 |
| AD-520891.1 | CGGUCCAAAGACGAAGUCGdTdT | 855 | AGACUUCGUCUUUGGACCGdTdT | 962 | CGGUCCAAAGACGAAGUCG | 1069 |
| AD-521833.1 | CUGAGUGGGUUUAUGAAAUdTdT | 856 | AUUCAUAAAACCAACCAGAdTdT | 963 | CUGAGUGGGUUUAUGAAA | 1070 |
| AD-521461.1 | UCUGCCAUUGCGAUUGUCCdTdT | 857 | AGACAAUCGCAAUGGCAGAdTdT | 964 | UCUGCCAUUGCGAUUGUCC | 1071 |
| AD-521386.1 | GGAUACAUGAGCAAGAUUUdTdT | 858 | AAAUCUUGCUCAUGUAUCCdTdT | 965 | GGAUACAUGAGCAAGAUUU | 1072 |
| AD-521123.1 | GGGAGAUAUAGCCUUCGAdTdT | 859 | ACGAAGGCAUAUCUCCCdTdT | 966 | GGGAGAGAUAUAGCCUUCGA | 1073 |
| AD-520899.1 | AGACGAAGUCGUGGAUGCCdTdT | 860 | AGCAUCCACGACUUCGUCUdTdT | 967 | AGACGAAGUCGUGGAUGCC | 1074 |
| AD-521089.1 | GGGAACCUCUACCUUCUCUdTdT | 861 | AGAGAAGGUAGAGGUUCCCdTdT | 968 | GGGAACCUCUACCUUCUCU | 1075 |
| AD-521407.1 | CUUGCUACCCAUUAGGAUUdTdT | 862 | AAUCCUAAUGGGUAGCAAGdTdT | 969 | CUUGCUACCCAUUAGGAUA | 1076 |
| AD-520898.1 | AAGACGAAGUCGUGGAUGCdTdT | 863 | ACAUCCACGACUUCGUCUUdTdT | 970 | AAGACGAAGUCGUGGAUGC | 1077 |
| AD-521378.1 | ACAAAGGUGAUACAUGAGdTdT | 864 | AUCAUGUAUCCACCUUUGUdTdT | 971 | ACAAAGGUGAUACAUGAG | 1078 |
| AD-521500.1 | CAGAUAUGCCCGACGAUGUdTdT | 865 | ACAUCGUCGGGCAUAUCUGdTdT | 972 | CAGAUAUGCCCGACGAUGU | 1079 |

TABLE 7-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-521798.1 | CAUUGCUGUGUAGUGACCUdTdT | 866 | AGGUCACUACACAGCAAUGdTdT | 973 | CAUUGCUGUGUAGUGACCCC | 1080 |
| AD-521902.1 | UCAGCAUGCGUUAAUUCAGdTdT | 867 | AUGAAUUAACGCAUGCUGAdTdT | 974 | UCAGCAUGCGUUAAUUCAG | 1081 |
| AD-521896.1 | UAAUACAUCAGCAUGCGUUdTdT | 868 | AACGCAUGCUGAUGUAUUAdTdT | 975 | UAAUACAUCAGCAUGCGUU | 1082 |
| AD-521989.1 | AUGGUCAGACAGUUCCAGUdTdT | 869 | ACUGGAACAGUCUGACCAUdTdT | 976 | AUGGUCAGACAGUUCCAGC | 1083 |
| AD-520896.1 | CAAAGACGAAGUCGUGGAUdTdT | 870 | AUCCACGACUUCGUCUUUGdTdT | 977 | CAAAGACGAAGUCGUGGAU | 1084 |
| AD-69024.2 | CCUAACUAAAAAUAAUGUUdTdT | 871 | AAACAUUAUUUUAGUUAGGdTdT | 978 | CCUAACUAAAAAUAAUGUUU | 1085 |
| AD-522146.1 | CACCUAACUAAAAAUAAUGdTdT | 872 | ACAUUAUUUUUAGUUAGGUGdTdT | 979 | CACCUAACUAAAAAUAAUGU | 1086 |
| AD-522432.1 | AGAUUGCACCUAACUAAUCdTdT | 873 | AAAUGAAAUGGUCAACUdTdT | 980 | AGAUUGCACCUAAUUCAUUC | 1087 |
| AD-521020.1 | CUGCCCUAAAGUCAAGUCCdTdT | 874 | AGACUUGACUUUAGGGCAGdTdT | 981 | CUGCCCUAAAGUCAAGUCC | 1088 |
| AD-521668.1 | CUUCUGGGCAAUAAAAGUAdTdT | 875 | AACUUUAUUGCCCAAGAAGdTdT | 982 | CUUCUGGGCAAUAAAAGUA | 1089 |
| AD-522097.1 | UAACCUUGACUACUAAAAUdTdT | 876 | AUUUUAGUAGUCAAGGUUAdTdT | 983 | UAACCUUGACUACUAAAAA | 1090 |
| AD-520999.1 | AUGCCAAAACACCAUCACdTdT | 877 | AUGAUGGUUGUUUUGGCAUdTdT | 984 | AUGCCAAAACACCAUCAC | 1091 |
| AD-521832.1 | GCUGAGUUGGUUUUAUGAAdTdT | 878 | AUCAUAAAACCAACUCAGCdTdT | 985 | GCUGAGUUGGUUUUAUGAA | 1092 |
| AD-520894.1 | UCCAAAGACGAAGUCGUGGdTdT | 879 | ACACGACUUCGUCUUUGGAdTdT | 986 | UCCAAAGACGAAGUCGUGG | 1093 |
| AD-522144.1 | UUCACCUAACUAAAAAUAAdTdT | 880 | AUUAUUUUUAGUUAGGUGAAdTdT | 987 | UUCACCUAACUAAAAAUAAU | 1094 |
| AD-521408.1 | UUGCUACCAUUAGGAUAAdTdT | 881 | AUAUCCUAAUGGGUAGCAAdTdT | 988 | UUGCUACCAUUAGGAUAA | 1095 |
| AD-521128.1 | AGAUAUGCCUUCGAGGAUAdTdT | 882 | AUCCUCGAAGGCAUAUCUdTdT | 989 | AGAUAUGCCUUCGAGGAUA | 1096 |
| AD-521980.1 | GCCCUAUUAAUGGUCAGACdTdT | 883 | AUCUGACCAUUAAUAGGGCdTdT | 990 | GCCCUAUUAAUGGUCAGAC | 1097 |
| AD-521406.1 | ACUUGCUACCCAUUAGGAUdTdT | 884 | AUCCUAAUGGGUAGCAAGUdTdT | 991 | ACUUGCUACCCAUUAGGAU | 1098 |
| AD-521131.1 | UAUGCCUUCGAGGAUAUUUdTdT | 885 | AAAUAUCCUCGAAGGCAUAdTdT | 992 | UAUGCCUUCGAGGAUAUUU | 1099 |
| AD-521909.1 | GCGUUAAUUCAGCUGGUUGdTdT | 886 | AAACCAGCUGAAUUAACGCdTdT | 993 | GCGUUAAUUCAGCUGGUUG | 1100 |
| AD-521954.1 | GAGGGUCCCUUACUGACUGdTdT | 887 | AAGUCAGUAAGGGACCCUCdTdT | 994 | GAGGGUCCCUUACUGACUG | 1101 |
| AD-520872.1 | CGUUCGGUGUCUGACUUUdTdT | 888 | AAAGUCAGACACCAGAACGdTdT | 995 | CGUUCGGUGUCUGACUUU | 1102 |
| AD-522142.1 | UUUUCACCUAACUAAAAUAdTdT | 889 | AAUUUUAGUUAGGUGAAAAdTdT | 996 | UUUUCACCUAACUAAAAUA | 1103 |

TABLE 7-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-520994.1 | CAUUGAUGCCAAAACAACUdTdT | 890 | AGUUGUUUUGGCAUCAAUGdTdT | 997 | CAUUGAUGCCAAAACAACC | 1104 |
| AD-520886.1 | ACUUUCGGUCCAAAGACGAdTdT | 891 | ACGUCUUUGGACCGAAAGUdTdT | 998 | ACUUUCGGUCCAAAGACGA | 1105 |
| AD-521987.1 | UAAUGGUCAGAGACUGUUCCdTdT | 892 | AGGAACAGUCUGACCAUUAdTdT | 999 | UAAUGGUCAGAGACUGUUCCA | 1106 |
| AD-521988.1 | AAUGGUCAGAGACUGUUCCAdTdT | 893 | AUGGAACAGUCUGACCAUUdTdT | 1000 | AAUGGUCAGAGACUGUUCCAG | 1107 |
| AD-520785.1 | AAGCAAGUUCCUCCGACAGdTdT | 894 | AUGUCGGAGGAACUUGCUUdTdT | 1001 | AAGCAAGUUCCUCCGACAG | 1108 |
| AD-521919.1 | AGCUGGUUGGGAAAUGACAdTdT | 895 | AGUCAUUUCCCAACCAGCUdTdT | 1002 | AGCUGGUUGGGAAAUGACA | 1109 |
| AD-521121.1 | CUGGGAGAGAUAUGCCUUUdTdT | 896 | AAAGGCAUAUCUCCCCAGdTdT | 1003 | CUGGGAGAGAUAUGCCUUC | 1110 |
| AD-522202.1 | GAGAUGUUAGUAGAAUAAGdTdT | 897 | AUUAUUCUACUAACAUCUCdTdT | 1004 | GAGAUGUUAGUAGAAUAAG | 1111 |
| AD-521130.1 | AUAUGCCUUCGAGGAUAUUdTdT | 898 | AAUAUCCUCGAAGGCAUAUdTdT | 1005 | AUAUGCCUUCGAGGAUAUU | 1112 |
| AD-521908.1 | UGCGUUAAUUCAGCUGGUUdTdT | 899 | AACCAGCUGAAUUAACGCAdTdT | 1006 | UGCGUUAAUUCAGCUGGUU | 1113 |
| AD-522173.1 | UUGUUACCUGUUGAAUUUUdTdT | 900 | AAAAUUCAACAGGUAACAAdTdT | 1007 | UUGUUACCUGUUGAAUUUU | 1114 |
| AD-521785.1 | GCAGCUACCUCCGCAUUGdTdT | 901 | ACAAUGCGGAGGUAGCUGCdTdT | 1008 | GCAGCUACCUCCGCAUUGC | 1115 |
| AD-520890.1 | UCGGUCCAAAGACGAAGUUdTdT | 902 | AACUUCGUCUUUGGACCGAdTdT | 1009 | UCGGUCCAAAGACGAAGUC | 1116 |
| AD-520978.1 | AGUGACAACGUACCCUUCdTdT | 903 | AGAAGGGUACGUUGUCACUdTdT | 1010 | AGUGACAACGUACCCUUCA | 1117 |
| AD-521744.1 | GUCUAGCAGAUUCUGCUAGACdTdT | 904 | AUGAAAAGAAUCUGCUAGACdTdT | 1011 | GUCUAGCAGAUUCUUUCAG | 1118 |
| AD-521021.1 | UGCCCUAAAGUCAAGUCCAdTdT | 905 | AGGACUUGACUUUAGGGCAdTdT | 1012 | UGCCCUAAAGUCAAGUCCA | 1119 |
| AD-521197.1 | UCCUCAGAAGGGAUGGAUCdTdT | 906 | AAUCCAUCCCUUCUGAGGAdTdT | 1013 | UCCUCAGAAGGGAUGGAUC | 1120 |
| AD-521379.1 | CAAAGGUGGAUACAUGAGCdTdT | 907 | ACUCAUGUAUCCACCUUUGdTdT | 1014 | CAAAGGUGGAUACAUGAGC | 1121 |
| AD-520925.1 | UCUACAGUGGCCUUAUCCCdTdT | 908 | AGGAUAAGGCCACUGUAGAdTdT | 1015 | UCUACAGUGGCCUUAUCCC | 1122 |
| AD-520888.1 | UUUCGGUCCAAAGACGAAGdTdT | 909 | AUUCGUCUUUGGACCGAAAdTdT | 1016 | UUUCGGUCCAAAGACGAAG | 1123 |
| AD-520975.1 | GUGAGUGACAACGUACCCUdTdT | 910 | AGGGUACGUUGUCACUCACdTdT | 1017 | GUGAGUGACAACGUACCCU | 1124 |
| AD-521666.1 | UUCUUCUUGGGCAAUAAAGdTdT | 911 | AUUUAUUGCCCAAGAAGAAdTdT | 1018 | UUCUUCUUGGGCAAUAAAG | 1125 |
| AD-521922.1 | UGGUUGGGAAAUGACACCAdTdT | 912 | AGGUGUCAUUUCCCAACCAdTdT | 1019 | UGGUUGGGAAAUGACACCA | 1126 |
| AD-521986.1 | UUAAUGGUCAGACUGUUCCdTdT | 913 | AGAACAGUCUGACCAUUAAdTdT | 1020 | UUAAUGGUCAGACUGUUCC | 1127 |

TABLE 7-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-521915.1 | AUUCAGCUGGUUGGGAAAUdTdT | 914 | AUUUCCCAACCAGCUGAAUdTdT | 1021 | AUUCAGCUGGUUGGGAAAU | 1128 |
| AD-520897.1 | AAAGACGAAGUCGUGGAUUdTdT | 915 | AAUCCACGACUUCGUCUUUdTdT | 1022 | AAAGACGAAGUCGUGGAUG | 1129 |
| AD-520889.1 | UUCGGUCCAAAGACGAAGUdTdT | 916 | ACUUCGUCUUUGGACCGAAdTdT | 1023 | UUCGGUCCAAAGACGAAGU | 1130 |
| AD-520885.1 | GACUUUCGGUCCAAAGACUdTdT | 917 | AGUCUUUGGACCGAAAGUCdTdT | 1024 | GACUUUCGGUCCAAAGACG | 1131 |
| AD-521469.1 | UGCCGAUUGUCCAGAGACUdTdT | 918 | AAGUCUCUGGACAAUCGCAdTdT | 1025 | UGCCGAUUGUCCAGAGACUG | 1132 |
| AD-521674.1 | GGGCAAUAAAGUACCUGCUdTdT | 919 | AGCAGGUACUUUAUUGCCCdTdT | 1026 | GGGCAAUAAAGUACCUGCU | 1133 |
| AD-521983.1 | CUAUUAAUGGUCAGACUGUdTdT | 920 | ACAGUCUGACCAUUAAUAGdTdT | 1027 | CUAUUAAUGGUCAGACUGU | 1134 |
| AD-521385.1 | UGGAUACAUGAGCAAGAUUdTdT | 921 | AAUCUUGCUCAUGUAUCCAdTdT | 1028 | UGGAUACAUGAGCAAGAUU | 1135 |
| AD-521937.1 | ACCAGGAAGCCCAGUGCAUdTdT | 922 | AUGCACUGGGCUUCCUGGUdTdT | 1029 | ACCAGGAAGCCCAGUGCAG | 1136 |
| AD-522141.1 | UUUUCACCUAACUAAAAAUdTdT | 923 | AUUUUAGUUAGGUGAAAAAdTdT | 1030 | UUUUCACCUAACUAAAAAU | 1137 |
| AD-522143.1 | UUUCACCUAACUAAAAAUAdTdT | 924 | AUAUUUUAGUUAGGUGAAAdTdT | 1031 | UUUCACCUAACUAAAAUAA | 1138 |
| AD-521669.1 | UUCUUGGGCAAUAAAGUACdTdT | 925 | AUACUUUAUUGCCCAAGAAdTdT | 1032 | UUCUUGGGCAAUAAAGUAC | 1139 |

TABLE 8

Unmodified Sense and Antisense Strand Sequences of PNPLA3 dsRNA Agents

| Duplex Name | Sense Sequence 5'to 3' | SEQ ID NO: | Range in NM_025225.2 | Antisense Sequence 5'to 3' | SEQ ID NO: | Range in NM_025225.2 |
|---|---|---|---|---|---|---|
| AD-520062.3 | ACCUUUUUCACCUAACUAAAU | 1140 | 2180-2200 | AUUUAGUUAGGUGAAAAAGGUGU | 1230 | 2178-2200 |
| AD-520060.1 | ACACCUUUUUCACCUAACUAU | 1141 | 2178-2198 | AUAGUUAGGUGAAAAAGGUGUUC | 1231 | 2176-2198 |
| AD-520064.3 | CUUUUUCACCUAACUAAAAUU | 1142 | 2182-2202 | AAUUUUAGUUAGGUGAAAAAGGU | 1232 | 2180-2202 |
| AD-518983.1 | ACUUUCUUCAUGUGGACAUCU | 1143 | 775-795 | AGAUGUCCACAUGAAGAAAGUUC | 1233 | 773-795 |
| AD-520061.1 | CACCUUUUUCACCUAACUAAU | 1144 | 2179-2199 | AUUAGUUAGGUGAAAAAGGUGUU | 1234 | 2177-2199 |
| AD-520063.2 | CCUUUUUCACCUAACUAAAAU | 1145 | 2181-2201 | AUUUUAGUUAGGUGAAAAAGGUG | 1235 | 2179-2201 |
| AD-519615.1 | UCCACCUUUCCCAGUUUUUCU | 1146 | 1581-1601 | AGAAAAACUGGGAAAGGUGGAGA | 1236 | 1579-1601 |
| AD-519757.1 | CUGAGUUGGUUUUAUGAAAAU | 1147 | 1746-1766 | AUUUUCAUAAAACCAACUCAGCU | 1237 | 1744-1766 |
| AD-519329.1 | AAGAUUUGCAACUUGCUACCU | 1148 | 1194-1214 | AGGUAGCAAGUUGCAAAUCUUGC | 1238 | 1192-1214 |
| AD-519324.1 | UGAGCAAGAUUUGCAACUUGU | 1149 | 1189-1209 | ACAAGUUGCAAAUCUUGCUCAUG | 1239 | 1187-1209 |
| AD-518811.1 | AAACGUUCUGGUGUCUGACUU | 1150 | 548-568 | AAGUCAGACACCAGAACGUUUUC | 1240 | 546-568 |
| AD-520059.1 | AACACCUUUUUCACCUAACUU | 1151 | 2177-2197 | AAGUUAGGUGAAAAAGGUGUUCU | 1241 | 2175-2197 |
| AD-519616.1 | CCACCUUUCCCAGUUUUUCAU | 1152 | 1582-1602 | AUGAAAAACUGGGAAAGGUGGAG | 1242 | 1580-1602 |
| AD-518655.1 | CAGGUCCUCUCAGAUCUUGUU | 1153 | 372-392 | AACAAGAUCUGAGAGGACCUGCA | 1243 | 370-392 |
| AD-519617.1 | CACCUUUCCCAGUUUUUCACU | 1154 | 1583-1603 | AGUGAAAAACUGGGAAAGGUGGA | 1244 | 1581-1603 |
| AD-519307.1 | AAAGACAAAGGUGGAUACAUU | 1155 | 1170-1190 | AAUGUAUCCACCUUUGUCUUUCA | 1245 | 1168-1190 |
| AD-520065.3 | UUUUUCACCUAACUAAAAUAU | 1156 | 2183-2203 | AUAUUUUAGUUAGGUGAAAAAGG | 1246 | 2181-2203 |
| AD-519323.1 | AUGAGCAAGAUUUGCAACUUU | 1157 | 1188-1208 | AAAGUUGCAAAUCUUGCUCAUGU | 1247 | 1186-1208 |
| AD-519331.1 | AUUUGCAACUUGCUACCCAUU | 1158 | 1197-1217 | AAUGGGUAGCAAGUUGCAAAUCU | 1248 | 1195-1217 |
| AD-518922.1 | GACAACGUACCCUUCAUUGAU | 1159 | 684-704 | AUCAAUGAAGGGUACGUUGUCAC | 1249 | 682-704 |
| AD-519339.1 | UUGCUACCCAUUAGGAUAAUU | 1160 | 1206-1226 | AAUUAUCCUAAUGGGUAGCAAGU | 1250 | 1204-1226 |
| AD-67552.2 | UGCCUUCGAGGAUAUUUGGAU | 1161 | 885-905 | AUCCAAAUAUCCUCGAAGGCAUA | 1251 | 883-905 |
| AD-519756.1 | GCUGAGUUGGUUUUAUGAAAU | 1162 | 1745-1765 | AUUUCAUAAAACCAACUCAGCUC | 1252 | 1743-1765 |
| AD-519333.1 | UUGCAACUUGCUACCCAUUAU | 1163 | 1199-1219 | AUAAUGGGUAGCAAGUUGCAAAU | 1253 | 1197-1219 |
| AD-519612.1 | CUCUCCACCUUUCCCAGUUUU | 1164 | 1578-1598 | AAAACUGGGAAAGGUGGAGAGCC | 1254 | 1576-1598 |
| AD-519762.1 | UUGGUUUUAUGAAAAGCUAGU | 1165 | 1751-1771 | ACUAGCUUUUCAUAAAACCAACU | 1255 | 1749-1771 |
| AD-75265.3 | CAUGAGCAAGAUUUGCAACUU | 1166 | 1187-1207 | AAGUUGCAAAUCUUGCUCAUGUA | 1256 | 1185-1207 |
| AD-67554.5 | UCUGAGCUGAGUUGGUUUUAU | 1167 | 1740-1760 | AUAAAACCAACUCAGCUCAGAGG | 1257 | 1738-1760 |
| AD-518928.1 | GUACCCUUCAUUGAUGCCAAU | 1168 | 690-710 | AUUGGCAUCAAUGAAGGGUACGU | 1258 | 688-710 |
| AD-519578.1 | GUCCAGCCUGAACUUCUUCUU | 1169 | 1526-1546 | AAGAAGAAGUUCAGGCUGGACCU | 1259 | 1524-1546 |
| AD-75277.3 | CUUGCUACCCAUUAGGAUAAU | 1170 | 1205-1225 | AUUAUCCUAAUGGGUAGCAAGUU | 1260 | 1203-1225 |
| AD-519317.1 | UGGAUACAUGAGCAAGAUUUU | 1171 | 1181-1201 | AAAAUCUUGCUCAUGUAUCCACC | 1261 | 1179-1201 |
| AD-67581.5 | CCUAUUAAUGGUCAGACUGUU | 1172 | 1900-1920 | AACAGUCUGACCAUUAAUAGGGC | 1262 | 1898-1920 |
| AD-519753.1 | UGAGCUGAGUUGGUUUUAUGU | 1173 | 1742-1762 | ACAUAAAACCAACUCAGCUCAGA | 1263 | 1740-1762 |
| AD-518701.1 | AUCUUCCAUCCAUCCUUCAAU | 1174 | 420-440 | AUUGAAGGAUGGAUGGAAGAUGC | 1264 | 418-440 |
| AD-519752.1 | CUGAGCUGAGUUGGUUUUAUU | 1175 | 1741-1761 | AAUAAAACCAACUCAGCUCAGAG | 1265 | 1739-1761 |
| AD-519328.1 | CAAGAUUUGCAACUUGCUACU | 1176 | 1193-1213 | AGUAGCAAGUUGCAAAUCUUGCU | 1266 | 1191-1213 |

TABLE 8-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-519322.1 | ACAUGAGCAAGAUUUGCAACU | 1177 | 1186-1206 | AGUUGCAAAUCUUGCUCAUGUAU | 1267 | 1184-1206 |
| AD-519911.1 | CUAUUAAUGGUCAGACUGUUU | 1178 | 1901-1921 | AAACAGUCUGACCAUUAAUAGGG | 1268 | 1899-1921 |
| AD-519029.1 | AGGGAACCUCUACCUUCUCUU | 1179 | 821-841 | AAGAGAAGGUAGAGGUUCCCUGU | 1269 | 819-841 |
| AD-519913.1 | AUUAAUGGUCAGACUGUUCCU | 1180 | 1903-1923 | AGGAACAGUCUGACCAUUAAUAG | 1270 | 1901-1923 |
| AD-518924.1 | CAACGUACCCUUCAUUGAUGU | 1181 | 686-706 | ACAUCAAUGAAGGGUACGUUGUC | 1271 | 684-706 |
| AD-519766.1 | UUUUAUGAAAAGCUAGGAAGU | 1182 | 1755-1775 | ACUUCCUAGCUUUUCAUAAAACC | 1272 | 1753-1775 |
| AD-519069.1 | UAUGCCUUCGAGGAUAUUUGU | 1183 | 883-903 | ACAAAUAUCCUCGAAGGCAUAUC | 1273 | 881-903 |
| AD-519614.1 | CUCCACCUUUCCCAGUUUUUU | 1184 | 1580-1600 | AAAAAACUGGGAAAGGUGGAGAG | 1274 | 1578-1600 |
| AD-519618.1 | ACCUUUCCCAGUUUUUCACUU | 1185 | 1584-1604 | AAGUGAAAAACUGGGAAAGGUGG | 1275 | 1582-1604 |
| AD-519326.1 | AGCAAGAUUUGCAACUUGCUU | 1186 | 1191-1211 | AAGCAAGUUGCAAAUCUUGCUCA | 1276 | 1189-1211 |
| AD-518920.1 | GUGACAACGUACCCUUCAUUU | 1187 | 682-702 | AAAUGAAGGGUACGUUGUCACUC | 1277 | 680-702 |
| AD-519760.1 | AGUUGGUUUUAUGAAAAGCUU | 1188 | 1749-1769 | AAGCUUUUCAUAAAACCAACUCA | 1278 | 1747-1769 |
| AD-518813.1 | CGUUCUGGUGUCUGACUUUCU | 1189 | 551-571 | AGAAAGUCAGACACCAGAACGUU | 1279 | 549-571 |
| AD-519396.1 | UCUGCCAUUGCGAUUGUCCAU | 1190 | 1263-1283 | AUGGACAAUCGCAAUGGCAGAUU | 1280 | 1261-1283 |
| AD-519935.1 | CAUGAGGUUCUUAGAAUGACU | 1191 | 1925-1945 | AGUCAUUCUAAGAACCUCAUGCU | 1281 | 1923-1945 |
| AD-519758.1 | UGAGUUGGUUUUAUGAAAAGU | 1192 | 1747-1767 | ACUUUUCAUAAAACCAACUCAGC | 1282 | 1745-1767 |
| AD-518831.1 | CGGUCCAAAGACGAAGUCGUU | 1193 | 570-590 | AACGACUUCGUCUUUGGACCGAA | 1283 | 568-590 |
| AD-518923.1 | ACAACGUACCCUUCAUUGAUU | 1194 | 685-705 | AAUCAAUGAAGGGUACGUUGUCA | 1284 | 683-705 |
| AD-519755.2 | AGCUGAGUUGGUUUUAUGAAU | 1195 | 1744-1764 | AUUCAUAAAACCAACUCAGCUCA | 1285 | 1742-1764 |
| AD-520116.1 | UGUGAAUCAGUGAGAUGUUAU | 1196 | 2265-2285 | AUAACAUCUCACUGAUUCACAUA | 1286 | 2263-2285 |
| AD-519093.1 | AUUCAGGUUCUUGGAAGAGAU | 1197 | 908-928 | AUCUCUUCCAAGAACCUGAAUGC | 1287 | 906-928 |
| AD-67588.2 | AACGUUCUGGUGUCUGACUUU | 1198 | 549-569 | AAAGUCAGACACCAGAACGUUUU | 1288 | 547-569 |
| AD-519754.3 | GAGCUGAGUUGGUUUUAUGAU | 1199 | 1743-1763 | AUCAUAAAACCAACUCAGCUCAG | 1289 | 1741-1763 |
| AD-519308.1 | AAGACAAAGGUGGAUACAUGU | 1200 | 1171-1191 | ACAUGUAUCCACCUUUGUCUUUC | 1290 | 1169-1191 |
| AD-519759.1 | GAGUUGGUUUUAUGAAAAGCU | 1201 | 1748-1768 | AGCUUUUCAUAAAACCAACUCAG | 1291 | 1746-1768 |
| AD-519763.1 | UGGUUUUAUGAAAAGCUAGGU | 1202 | 1752-1772 | ACCUAGCUUUUCAUAAAACCAAC | 1292 | 1750-1772 |
| AD-519327.1 | GCAAGAUUUGCAACUUGCUAU | 1203 | 1192-1212 | AUAGCAAGUUGCAAAUCUUGCUC | 1293 | 1190-1212 |
| AD-519761.1 | GUUGGUUUUAUGAAAAGCUAU | 1204 | 1750-1770 | AUAGCUUUUCAUAAAACCAACUC | 1294 | 1748-1770 |
| AD-518702.1 | UCUUCCAUCCAUCCUUCAACU | 1205 | 421-441 | AGUUGAAGGAUGGAUGGAAGAUG | 1295 | 419-441 |
| AD-519094.1 | UUCAGGUUCUUGGAAGAGAAU | 1206 | 909-929 | AUUCUCUUCCAAGAACCUGAAUG | 1296 | 907-929 |
| AD-518832.1 | GGUCCAAAGACGAAGUCGUGU | 1207 | 571-591 | ACACGACUUCGUCUUUGGACCGA | 1297 | 569-591 |
| AD-519767.1 | UUUAUGAAAAGCUAGGAAGCU | 1208 | 1756-1776 | AGCUUCCUAGCUUUUCAUAAAAC | 1298 | 1754-1776 |
| AD-518917.1 | UGAGUGACAACGUACCCUUCU | 1209 | 679-699 | AGAAGGGUACGUUGUCACUCACU | 1299 | 677-699 |
| AD-518988.1 | CUUCAUGUGGACAUCACCAUU | 1210 | 780-800 | AUGGUGAUGUCCACAUGAAGAA | 1300 | 778-800 |
| AD-519305.1 | UGAAAGACAAAGGUGGAUACU | 1211 | 1168-1188 | AGUAUCCACCUUUGUCUUUCAUU | 1301 | 1166-1188 |
| AD-519613.1 | UCUCCACCUUUCCCAGUUUUU | 1212 | 1579-1599 | AAAAACUGGGAAAGGUGGAGAGC | 1302 | 1577-1599 |
| AD-519121.1 | CCUGAAGUCAUCCUCAGAAGU | 1213 | 956-976 | ACUUCUGAGGAUGACUUCAGGCC | 1303 | 954-976 |

TABLE 8-continued

Unmodified Sense and Antisense Strand Sequences of PNPLA3 dsRNA Agents

| Duplex Name | Sense Sequence 5'to 3' | SEQ ID NO: | Range in NM_025225.2 | Antisense Sequence 5'to 3' | SEQ ID NO: | Range in NM_025225.2 |
|---|---|---|---|---|---|---|
| AD-519095.1 | UCAGGUUCUUGGAAGAGAAGU | 1214 | 910-930 | ACUUCUCUUCCAAGAACCUGAAU | 1304 | 908-930 |
| AD-518982.1 | AACUUUCUUCAUGUGGACAUU | 1215 | 774-794 | AAUGUCCACAUGAAGAAAGUUCG | 1305 | 772-794 |
| AD-519096.1 | CAGGUUCUUGGAAGAGAAGGU | 1216 | 911-931 | ACCUUCUCUUCCAAGAACCUGAA | 1306 | 909-931 |
| AD-518986.1 | UUCUUCAUGUGGACAUCACCU | 1217 | 778-798 | AGGUGAUGUCCACAUGAAGAAAG | 1307 | 776-798 |
| AD-518921.1 | UGACAACGUACCCUUCAUUGU | 1218 | 683-703 | ACAAUGAAGGGUACGUUGUCACU | 1308 | 681-703 |
| AD-518985.1 | UUUCUUCAUGUGGACAUCACU | 1219 | 777-797 | AGUGAUGUCCACAUGAAGAAAGU | 1309 | 775-797 |
| AD-518984.1 | CUUUCUUCAUGUGGACAUCAU | 1220 | 776-796 | AUGAUGUCCACAUGAAGAAAGUU | 1310 | 774-796 |
| AD-519325.1 | GAGCAAGAUUUGCAACUUGCU | 1221 | 1190-1210 | AGCAAGUUGCAAAUCUUGCUCAU | 1311 | 1188-1210 |
| AD-518812.1 | ACGUUCUGGUGUCUGACUUUU | 1222 | 550-570 | AAAAGUCAGACACCAGAACGUUU | 1312 | 548-570 |
| AD-518987.1 | UCUUCAUGUGGACAUCACCAU | 1223 | 779-799 | AUGGUGAUGUCCACAUGAAGAAA | 1313 | 777-799 |
| AD-518958.1 | CAUCUGCCCUAAAGUCAAGUU | 1224 | 749-769 | AACUUGACUUUAGGGCAGAUGUC | 1314 | 747-769 |
| AD-67572.2 | UUCUUUCAGAGGUGCUAAAGU | 1225 | 1647-1667 | ACUUUAGCACCUCUGAAAGAAUC | 1315 | 1645-1667 |
| AD-518980.1 | CGAACUUUCUUCAUGUGGACU | 1226 | 772-792 | AGUCCACAUGAAGAAAGUUCGUG | 1316 | 770-792 |
| AD-519070.1 | AUGCCUUCGAGGAUAUUUGGU | 1227 | 884-904 | ACCAAAUAUCCUCGAAGGCAUAU | 1317 | 882-904 |
| AD-518925.1 | AACGUACCCUUCAUUGAUGCU | 1228 | 687-707 | AGCAUCAAUGAAGGGUACGUUGU | 1318 | 685-707 |
| AD-518981.1 | GAACUUUCUUCAUGUGGACAU | 1229 | 773-793 | AUGUCCACAUGAAGAAAGUUCGU | 1319 | 771-793 |

TABLE 9

Modified Sense and Antisense Strand Sequences of PNPLA3 dsRNA Agents

| Duplex Name | Sense Sequnce 5' to 3' | SEQ ID NO: Antisense Sequence 5' to 3' | SEQ ID NO: mRNA Target Sequence 5' to 3' | SEQ ID NO: |
|---|---|---|---|---|
| AD-520062.3 | ascscuuuUfuCfAfCfcuaacuaaaUL96 | 1320 asUfsuuaGfuUfAfggugAfaAfaaggugsu | 1410 ACACCUUUUCACCUAACUAAA | 1500 |
| AD-520060.1 | ascsaccuUfuUfCfaccuaacuaaUL96 | 1321 asUfsaguUfaGfGfugaaAfaAfguguususu | 1411 GAACACCUUUUCACCUAACUAA | 1501 |
| AD-520064.3 | csusuuuuCfaCfCfCfUfaacuaaaaaUL96 | 1322 asAfsuuuUfaGfUfuaggUfgAfaaaagsgsu | 1412 ACCUUUUCACCUAACUAAAAUA | 1502 |
| AD-518983.1 | ascsuuucUfuCfAfUfguggacaucuL96 | 1323 asGfsaugUfcCfAfcaugAfaGfaaagususc | 1413 GAACUUCUUCAUGGGACAUCA | 1503 |
| AD-520061.1 | csasccuuUfuUfCfAfccuaacuaaaUL96 | 1324 asUfsuagUfuAfGfguugAfaAfaaggugsusu | 1414 AACACCUUUUCACCUAACUAAA | 1504 |
| AD-520063.2 | cscsuuuuUfcAfCfCfuaacuaaaaaUL96 | 1325 asUfsuuuAfgUfUfagguGfaAfaaaggsusg | 1415 CACCUUUUCACCUAACUAAAAU | 1505 |
| AD-519615.1 | uscscaccUfuUfCfCfcaguuuuucuL96 | 1326 asGfsaaaAfaCfUfgggaAfaGfguggasgsa | 1416 UCUCCACCUUUCCAGUUUUUCA | 1506 |
| AD-519757.1 | csusgaguUfgGfUfUfuuaugaaaaUL96 | 1327 asUfsuuuCfaUfAfaaacCfaAfcucagscsu | 1417 AGCUGAGUGGUUUUAUGAAAAG | 1507 |
| AD-519329.1 | asasgauuUfgCfAfAfcuugcuaccuL96 | 1328 asGfsguaGfcAfAfguugCfaAfaucuusgsc | 1418 GCAAGAUUGCAACUGCUACCC | 1508 |
| AD-519324.1 | usgsagcaAfgAfUfUfugcaacuuguL96 | 1329 asCfsaagUfuGfCfaaaucfuUfcucasusg | 1419 CAUGAGCAAGAUUGCAACUGC | 1509 |
| AD-518811.1 | asasacguUfcUfGfGfuguscuaccuuL96 | 1330 asAfsgucAfgAfCfaccaGfaAfcguuususc | 1420 GAAAACGUUCUGGUGUCUGACU | 1510 |
| AD-520059.1 | asascaccUfuUfCfUfcaccuaacuuL96 | 1331 asAfsguuAfgGfUfgaaaAfaGfguguscu | 1421 AGAACACCUUUUCACCUAACUA | 1511 |
| AD-519616.1 | csscaccuUfuCfCfCfaguuuuucauL96 | 1332 asUfsgaaAfaAfCfugggAfaAfgggaasg | 1422 CUCCACCUUUCCCAGUUUUUCAC | 1512 |
| AD-518655.1 | csasgguccCfuCfUfCfagaucuuguuL96 | 1333 asAfsccaaGfuAfUfcugagAfgGfaccugscsa | 1423 UGCAGGUCCUCUCAGAUCUGUG | 1513 |
| AD-519617.1 | csasccuuUfcUfCfCfAfguuuuucacuL96 | 1334 asGfsugaAfaAfAfcuggGfaAfaggugsgsa | 1424 UCCACCUUUCCCAGUUUUUCACU | 1514 |
| AD-519307.1 | asasagacAfaAfGfGfuggauacauuL96 | 1335 asAfsuguAfuCfCfcuuUfGfucuuuscsa | 1425 UGAAAGACAAAGGUGGAUACAUG | 1515 |
| AD-520065.3 | ususuuucAfcCfUfUfAfacuaaaauaUL96 | 1336 asUfsauuUfuAfGfuuagGfuGfaaaaasgsg | 1426 CCUUUUCACCUAACUAAAAUAA | 1516 |
| AD-519323.1 | asusgagcAfaGfUfuugcaacuuuL96 | 1337 asAfsaguUfgCfAfaacuUfGfcucausgsu | 1427 ACAUGAGCAAGAUUGCAACUUG | 1517 |
| AD-519331.1 | asusuugcAfaCfUfUfgcuaccauuL96 | 1338 asAfsuggGfuAfGfcaagUfuGfcaaauscsu | 1428 AGAUUGCAACUUGCUACCCAUU | 1518 |
| AD-518922.1 | gsascaacGfuAfCfCfuucauugauL96 | 1339 asAfscaaUfgAfAfgggUfCfuugucsasc | 1429 GUGACAACGUACCCUUCAUUGAU | 1519 |
| AD-519339.1 | ususuugcuaCfgAfGfGfauauuuggauL96 | 1340 asUfscaaUfcCfUfaaugUfCfagcaagsu | 1430 ACUUGCUCCCAUUAGGAUAAUG | 1520 |
| AD-67552.2 | usgsccuuCfgAfGfGfauauuuggauL96 | 1341 asUfccaAfaAfUfAfuccuCfgAfaggcasusa | 1431 UAUGCCUUCGAGGAUAUUUGGAU | 1521 |
| AD-519756.1 | gscsugaGfuGfGfUfuuuugauaaUL96 | 1342 asUfsuucAfuAfAfaaccAfcUfcagcsusc | 1432 GAGCUGAGUGGUUUUAUGAAAA | 1522 |

TABLE 9-continued

Modified Sense and Antisense Strand Sequences of PNPLA3 dsRNA Agents

| Duplex Name | Sense Sequnce 5' to 3' | SEQ ID NO: Antisense Sequence 5' to 3' | SEQ ID NO: | mRNA Target Sequence 5' to 3' | SEQ ID NO: |
|---|---|---|---|---|---|
| AD-519333.1 | ususgcaaCfuUfGfCfuacccauuauL96 | 1343 asUfsauaUfgGfUfagcaAfgUfugcaaasasu | 1433 AUUUGCAACUUGCUACCCAUUAG | 1523 |
| AD-519612.1 | csuscuccAfcCfUfUfuccaguuuuuL96 | 1344 asAfsaacUfgGfGfaaagGfuGfgagagcscsu | 1434 GGCUCCCACCUUUCCCAGUUUU | 1524 |
| AD-519762.1 | ususgguuUfuAfUfGfGfaaaagcuaguL96 | 1345 ascCfsuagCfuUfUfucauAfaAfaccaascsu | 1435 AGUUGGUUUUAUGAAAAGCUAGG | 1525 |
| AD-75265.3 | csasugagCfaAfGfAfuuugcaacuL96 | 1346 asAfsguuGfcAfAfaucuUfgCfucaugsusa | 1436 UACAUGAGCAAGAUUUGCAACUU | 1526 |
| AD-67554.5 | uscsugagCfugAfGfuuggvuuuauL96 | 1347 asUfsaaaAfcCfAfacucAfgCfucagasgsg | 1437 CCCUGAGCUGAGUUGCAUUUAU | 1527 |
| AD-518928.1 | gsusacccUfuCfAfUfugaugccaauL96 | 1348 asUfsuggCfauFCfaaugAfaGfguacsgsu | 1438 ACGUACCCUUCAUUGAUGCCAAA | 1528 |
| AD-519578.1 | gsusccagCfcUfGfAfacucucucuL96 | 1349 asAfsgaaGfaAfGfuucaGfgCfuggacscsu | 1439 AGGUCCAGCCUGAACUUCUCUU | 1529 |
| AD-75277.3 | csususgcuAfcCfCfAfAfuuaggauaauL96 | 1350 asUfsuauCfcUfUfauggGfuAfcaagsusu | 1440 AACUUGCUACCCAUUAGGAUAAU | 1530 |
| AD-519317.1 | usgsgauaCfaUfGfAfgcaagauuuuL96 | 1351 asAfsaauCfuUfGfcucaUfUfauccascsc | 1441 GGUGGAUACAUGAGCAAGAUUUG | 1531 |
| AD-67581.5 | cscsuauuAfaUfGfGfucagacuguL96 | 1352 asAfscagUfcUfGfuaccaUfuAfauaggsgsc | 1442 GCCCUAUUAAUGGUCAGACUGUU | 1532 |
| AD-519753.1 | usgsgcuGfaGfUfGfUfgguuuaguL96 | 1353 ascCfsauaAfaAfCfcaacUfcAfgcucasgsa | 1443 UCUGAGCUGAGUUGCAUUCCUUCAC | 1533 |
| AD-518701.1 | asuscuucUfaUfCfCfauccuucaauL96 | 1354 asUfsugaAfgGfGfaagauUfgGfaagauLgsc | 1444 GCAUCUUCCAUCCAUCCUUCAAC | 1534 |
| AD-519752.1 | csusgagcUfgAfGfUfuugguuuuauL96 | 1355 asAfsuaAfcAfCfcacucUfcAfuucugscsu | 1445 CUCUGAGCUGAGUUGCACUUGCUACC | 1535 |
| AD-519328.1 | csasagauUfuGfCfAfAfacuugcuacuL96 | 1356 asGfsuagCfaAfGfuugcAfaAfucuugscsu | 1446 AGCAAGAUUUGCAACUUGCUACC | 1536 |
| AD-519322.1 | ascsaugaGfcAfAfGfauuugcaacuL96 | 1357 asGfsuugCfaAfAfiucuuGfcUfcauguasu | 1447 AUACAUGAGCAAGAUUUGCAACU | 1537 |
| AD-519911.1 | csusauuaAfuGfGfUfcagacuguuL96 | 1358 asAfsacaGfucUfGfaccAfuFauuagsgsg | 1448 CCCUAUUAAUGGUCAGACUGUUC | 1538 |
| AD-519029.1 | asgsggaaCfcCfUfUfaccucucuuL96 | 1359 asAfsgagAfaGfGfuagaGfgUfuccusgsu | 1449 ACAGGGAACCUUCUACCUUCUCUC | 1539 |
| AD-519913.1 | asusuaauGfuCfAfAfgacuguuccuL96 | 1360 asGfsgaaCfaGfUfcgaUfcFcauaauasag | 1450 CUAUUAAUGGUCAGACUGUUCCA | 1540 |
| AD-518924.1 | csasacguCfuAfCfCfUfucauugauguL96 | 1361 asCfsaucAfaUfGfaaggGftAfcguugsusc | 1451 GACAACGUACCCUUCAUUGAUGC | 1541 |
| AD-519766.1 | usususuauGfaAfAfgcuaggaaguL96 | 1362 asCfsuucCfuAfGfcuuuUfcAfuaaaascsc | 1452 GGUUUAUGAAAAGCUAGGAAGC | 1542 |
| AD-519069.1 | usasugccUfuCfGfAfggauauuuguL96 | 1363 ascCfsaaaUfaUfCfcucgAfaGfgcauasusc | 1453 GAUAUGCCUUCGAGGAUAUUUGG | 1543 |
| AD-519614.1 | csuscaccUfuGfCfAfGfuuuccaguuuuuL96 | 1364 asAfsaaaAfcUfGfgaaAfgGfuggagsasg | 1454 CUCUCCACCUUUCCCAGUUUUUC | 1544 |
| AD-519618.1 | ascscuuuCfcCfAfGfuuuuucacuL96 | 1365 asAfsgugAfaAfAfacugGfgAfaaggusgsg | 1455 CCACCUUUCCCAGUUUUUCACUA | 1545 |

TABLE 9-continued

Modified Sense and Antisense Strand Sequences of PNPLA3 dsRNA Agents

| Duplex Name | Sense Sequnce 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-519326.1 | asgscaagAfuUfUfGfcaacugcuuL96 | 1366 | asAfsgcaAfgUfUfgcaaAfuCfuugcuscsa | 1456 | UGAGCAAGAUUGCAACUGCUA | 1546 |
| AD-518920.1 | gsusgacaAfcGfUfAfcccuucauuuL96 | 1367 | asAfsaugaAfaGfGfguacGfuUfgucacsusc | 1457 | GAGUGACACGUACCCUCAUUG | 1547 |
| AD-519760.1 | asgsuuggUfuUfUfAfugaaagcuuL96 | 1368 | asAfsgcuUfiUfCfauaaAfaCfcaacuscsa | 1458 | UGAGUUGGUUUUAUGAAAAGCUA | 1548 |
| AD-518813.1 | csgsuucuGfgUfGfUfcugacuuucuL96 | 1369 | asGfsaaaGfucCfAfgacaCfcAfgaacgsusu | 1459 | AACGUUCUGGUGUCUGACUUUCG | 1549 |
| AD-519396.1 | uscsugccAfuUfGfCfgauuguccauL96 | 1370 | asUfsggaCfaAfUfcgcaAfuGfgcagasusu | 1460 | AAUCUGCCAUUGCGAUUGUCCAG | 1550 |
| AD-519935.1 | csasugagGfiUfCfUfuagaugacuL96 | 1371 | asGfsucaUfuCfUfuagaAfcCfucaugscsu | 1461 | AGCAUGAGGUUCUUAGAAUGACA | 1551 |
| AD-519758.1 | usgsaguuGfgUfUfUfuaugaaaguL96 | 1372 | asCfsuuuUfcAfUfaaaaCfcAfacucasgsc | 1462 | GCUGAGUUGGUUUUAUGAAAAGC | 1552 |
| AD-518831.1 | csgsguccAfaAfGfAfcgaagucguuL96 | 1373 | asAfscgaCfuUfCfgucuUfuGfgaccgsasa | 1463 | UUCGGUCCAAAGACGAAGUCGUG | 1553 |
| AD-518923.1 | ascsaacgUfaCfCfCfuucauugauuL96 | 1374 | asAfsucaAfuGfAfagggUfaCfguuguscsa | 1464 | UGACAACGUACCCUUCAUUGAUG | 1554 |
| AD-519755.2 | asgscugaGfuUfGfGfuuuuaugaaL96 | 1375 | asUfsucaUfaAfAfaccaAfcUfcagcuscsa | 1465 | UGAGCUGAGUUGGUUUUAUGAAA | 1555 |
| AD-520116.1 | usgsugaaUfcAfGfUfGfguuaugaauL96 | 1376 | asUfsaacAfucCfUfcacuGfaUfucacasusa | 1466 | UAUGUGAAUCAGUGAGAUGUUAG | 1556 |
| AD-519093.1 | asusucagGfuUfCfUfuggaagaguL96 | 1377 | asUfscucUfucCfCfaagaAfcCfugaausgsc | 1467 | GCAUUCAGGUUCUUGGAAGAGAA | 1557 |
| AD-67588.2 | asasscguuCfugGfUfGfgucgacuuuL96 | 1378 | asAfsaguCfaGfAfcaccAfgAfacguusususu | 1468 | AAAACGUCUGGUCGUCUGACUUU | 1558 |
| AD-519754.3 | gsaasgcugAfgUfUfGfguuuugaugauL96 | 1379 | asUfscauAfaAfAfcCfcaacCfcfagcucsasg | 1469 | CUGAGCUGAGUUGGUUUUAUGAA | 1559 |
| AD-519308.1 | asasgacaAfaGfGfUfggauacaguL96 | 1380 | asCfsaugUfaUfCfcaccUfuUfgucuususc | 1470 | GAAAGACAAAGGUGGAUACAUGA | 1560 |
| AD-519759.1 | gsasguugGfuuUfUfAfugaaaagcuL96 | 1381 | asGfscuuUfuCfAfuaaAfcCfaacucsasg | 1471 | CUGAGUUGGUUUUAUGAAAAGCU | 1561 |
| AD-519763.1 | usgsuguuUfaUfGfAfaaagcuaggL96 | 1382 | asCfscuaGfcUfUfuucaUfaAfaaccasasc | 1472 | GUUGGUUUUAUGAAAAGCUAGGA | 1562 |
| AD-519327.1 | gscsaagaUfuUfGfCfaacuugcuaL96 | 1383 | asUfsagcAfaGfUfugcAfaUfcuugcsusc | 1473 | GAGCAAGAUUGCAACUUGCUAC | 1563 |
| AD-519761.1 | gsusuggUfuUfAfUfgaaagcuaguL96 | 1384 | asUfsagcUfuUfUfcauaAfaCfcaacsusc | 1474 | GAGUUGGUUUUAUGAAAAGCUAG | 1564 |
| AD-518702.1 | uscsuuccAfucCfAfUfcccuucaacuL96 | 1385 | asGfsuugAfaGfGfgauggAfuGfgaagasusg | 1475 | CAUUCCCAUCCAUCCUUCAACU | 1565 |
| AD-519094.1 | ususcaggUfucCfUfuCfggaagagaauL96 | 1386 | asUfsucuCfuUfCfcaagAfaCfcugaasusg | 1476 | CAUUCAGGUUCUUGGAAGAGAAG | 1566 |
| AD-518832.1 | gsgsuccaAfaGfAfCfgaagucguuL96 | 1387 | asCfsacgAfcUfUfcgucUfuUfggaccsgsa | 1477 | UCGGUCCAAAGACGAAGUCGUG | 1567 |
| AD-519767.1 | ususuaugAfaAfAfGfcuaggaagcuL96 | 1388 | asGfscuuCfcUfAfgcuuUfuCfauaaaasasc | 1478 | GUUUUAUGAAAAGCUAGGAAGCA | 1568 |
| AD-518917.1 | usgsaguGfaCfAfAfCfguaccccuucuL96 | 1389 | asGfsaagGfuAfCfguuGfuCfacucascsu | 1479 | AGUGAGAGUGACAACGUACCCUUCA | 1569 |

TABLE 9-continued

Modified Sense and Antisense Strand Sequences of PNPLA3 dsRNA Agents

| Duplex Name | Sense Seqnce 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-518988.1 | csusucaugCfuGfGfAfcauccaccauL96 | 1390 | asUfsuggUfgAfUfguccAfcAfugaagasasa | 1480 | UUCUUCAUGUGGCAUCACCAAG | 1570 |
| AD-519305.1 | usgsaaagAfcAfAfAfggugauacuL96 | 1391 | asGfsuauCfcAfCfcuuuGfuCfuuucasusu | 1481 | AAUGAAAGACAAAGGUGAUACA | 1571 |
| AD-519613.1 | uscsuccaCfcUfUfUfcccaguuuuuL96 | 1392 | asAfsaaaCfuGfGfgaaaGfgUfggaagsgsc | 1482 | GCUCCCACCUUUCCAGUUUUU | 1572 |
| AD-519121.1 | cscsugaaGfuCfAfUfcccagaaguL96 | 1393 | asCfsuucUfgAfGfgaugAfcUfucaggscsc | 1483 | GGCCUGAAGUCAUCCUCAGAAGG | 1573 |
| AD-519095.1 | uscsagguUfcUfUfGfgaagagaaguL96 | 1394 | asCfsuucUfcUfUfccaaGfaAfccugasasu | 1484 | AUUCAGGUUCUUGGAAGAGAAGG | 1574 |
| AD-518982.1 | asascuuuuCfuUfCfAfuguggacauuL96 | 1395 | asAfsuguCfcAfCfaugaAfgAfaaguuscsg | 1485 | CGAACUUUCAUGUGGACAUC | 1575 |
| AD-519096.1 | csasgguuCfuUfGfGfaagaagagguL96 | 1396 | asCfscuuCfuCfUfccaAfgAfaccugsasa | 1486 | UUCAGGUUCUUGGAAGAGAAGGG | 1576 |
| AD-518986.1 | uususcuucAfuGfUfGfgacaucaccuL96 | 1397 | asGfsgugAfuGfUfccacAfuGfaagaasasg | 1487 | CUUUCUUCAUGUGGACAUCACCA | 1577 |
| AD-518921.1 | usgsacaaCfgUfAfCfccucauuguL96 | 1398 | asCfsaauGfaAfGfguacCfgUfugucascsu | 1488 | AGUGACAACCUACCCUCAUUGA | 1578 |
| AD-518985.1 | ususucuuCfaUfUfGfggacaucacuL96 | 1399 | asGfsugaUfgUfCfcacaUfgAfagaaasgsu | 1489 | ACUUUCUUCAUGUGGACAUCACC | 1579 |
| AD-518984.1 | csusucuuCfaUfUfGfuggacaucacuL96 | 1400 | asUfsgauGfucCfcacauGfaAfgaaagsusu | 1490 | AACUUUCUUCAUGUGGACAUCAC | 1580 |
| AD-519325.1 | gsasgcaaGfaUfUfUfgcaacuugcuL96 | 1401 | asGfscaaGfuUfGfcaaaUfcUfugcucsasu | 1491 | AUGAGCAAGAUUGCAACUUGCU | 1581 |
| AD-518812.1 | ascsguucUfgGfUfGfUfucugacuuuuL96 | 1402 | asAfsaagUfcAfGfacacCfaGfaacgususu | 1492 | AAACUUCUGGUGGUCUGACUUUC | 1582 |
| AD-518987.1 | uscsuucaUfUfGfGfAfacaccaagL96 | 1403 | asUfsgguGfuAfUfguccaCfuUfgaagaasa | 1493 | UUUCUUCAUGUGGACAUCACCAA | 1583 |
| AD-518958.1 | csasucugCfcCfUfAfAfaagucaaguL96 | 1404 | asAfscuuGfaCfUfuuagGfgCfagaugsusc | 1494 | GACAUCUGCCCUAAAGUCAAGUC | 1584 |
| AD-67572.2 | ususcuuuCfuUfCfUfUfcauggacuL96 | 1405 | asCfsuuuAfgCfAfccucUfgAfaagaasusc | 1495 | GAUUCUUCUUCAGAGUGCUAAAGU | 1585 |
| AD-518980.1 | csgsaacuUfucUfUfUfcauggacuL96 | 1406 | asGfsuccAfcAfUfgaagAfaAfguucgsusg | 1496 | CACGAACUUUCUUCAUGUGGACA | 1586 |
| AD-519070.1 | asusgccuUfcGfAfAfgauauugguL96 | 1407 | asCfscaaAfuAfUfcuucGfaAfggcauasu | 1497 | AUAUGCCUUCGAAGGAUAUUGGA | 1587 |
| AD-518925.1 | asascguaCfcCfUfUfcauugaugcuL96 | 1408 | asGfscauCfaAfUfgaagGfUfacguugsu | 1498 | ACAACGUACCCUUCAUUGAUGCC | 1588 |
| AD-518981.1 | gsasacuuUfcUfUfCfauggaGfAfaagauucsgsu | 1409 | asUfsguCfcAfUfugaaGfAfaaguucsgsu | 1499 | ACGAACUUUCUUCAUGUGGACAU | 1589 |

TABLE 10

Unmodified Sense and Antisense Strand Sequences of PNPLA3 dsRNA Agents

| Duplex Name | Sense Sequences | SEQ ID NO: | Range | Antisense Sequences | SEQ ID NO: | Range |
|---|---|---|---|---|---|---|
| AD-521086.1 | ACAGGGAACCUCUACCUUU | 1590 | 819-837 | AAAGGUAGAGGUUCCCUGU | 1626 | |
| AD-805632.1 | ACAGGGAACCUCUACCUUU | 1591 | | AAAGGUAGAGGUUCCCUGU | 1627 | 819-837 |
| AD-805644.1 | ACAGGGAACCUCUACCUUU | 1592 | | AAAGGUAGAGGUUCCCUGU | 1628 | |
| AD-521465.1 | CCAUUGCGAUUGUCCAGAU | 1593 | 1267-1285 | AUCUGGACAAUCGCAAUGG | 1629 | |
| AD-805631.1 | CCAUUGCGAUUGUCCAGAU | 1594 | | AUCUGGACAAUCGCAAUGG | 1630 | 1267-1285 |
| AD-805643.1 | CCAUUGCGAUUGUCCAGAU | 1595 | | AUCUGGACAAUCGCAAUGG | 1631 | |
| AD-520902.1 | CGAAGUCGUGGAUGCCUUU | 1596 | 581-599 | AAAGGCAUCCACGACUUCG | 1632 | 581-599 |
| AD-805634.1 | CGAAGUCGUGGAUGCCUUU | 1597 | | AAAGGCAUCCACGACUUCG | 1633 | |
| AD-805646.1 | CGAAGUCGUGGAUGCCUUU | 1598 | | AAAGGCAUCCACGACUUCG | 1634 | |
| AD-522140.1 | CUUUUUCACCUAACUAAAU | 1599 | 2182-2200 | AUUUAGUUAGGUGAAAAAG | 1635 | |
| AD-805635.1 | CUUUUUCACCUAACUAAAU | 1600 | | AUUUAGUUAGGUGAAAAAG | 1636 | 2182-2200 |
| AD-805647.1 | CUUUUUCACCUAACUAAAU | 1601 | | AUUUAGTUAGGUGAAAAAG | 1637 | |
| AD-520903.1 | GAAGUCGUGGAUGCCUUGU | 1602 | 582-600 | ACAAGGCAUCCACGACUUC | 1638 | |
| AD-805628.1 | GAAGUCGUGGAUGCCUUGU | 1603 | | ACAAGGCAUCCACGACUUC | 1639 | 582-600 |
| AD-805640.1 | GAAGUCGUGGAUGCCUUGU | 1604 | | ACAAGGCAUCCACGACUUC | 1640 | |
| AD-520973.1 | GAGUGAGUGACAACGUACU | 1605 | 676-694 | AGUACGUUGUCACUCACUC | 1641 | |
| AD-805625.1 | GAGUGAGUGACAACGUACU | 1606 | | AGUACGUUGUCACUCACUC | 1642 | 676-694 |
| AD-805637.1 | GAGUGAGUGACAACGUACU | 1607 | | AGUACGTUGUCACUCACUC | 1643 | |
| AD-521129.1 | GAUAUGCCUUCGAGGAUAU | 1608 | 881-899 | AUAUCCUCGAAGGCAUAUC | 1644 | |
| AD-805630.1 | GAUAUGCCUUCGAGGAUAU | 1609 | | AUAUCCUCGAAGGCAUAUC | 1645 | 881-899 |
| AD-805642.1 | GAUAUGCCUUCGAGGAUAU | 1610 | | AUAUCCTCGAAGGCAUAUC | 1646 | |
| AD-521124.1 | GGAGAGAUAUGCCUUCGAU | 1611 | 876-894 | AUCGAAGGCAUAUCUCUCC | 1647 | |
| AD-805626.1 | GGAGAGAUAUGCCUUCGAU | 1612 | | AUCGAAGGCAUAUCUCUCC | 1648 | 876-894 |
| AD-805638.1 | GGAGAGAUAUGCCUUCGAU | 1613 | | AUCGAAGGCAUAUCUCUCC | 1649 | |
| AD-521420.1 | GGAUAAUGUCUUAUGUAAU | 1614 | 1219-1237 | AUUACAUAAGACAUUAUCC | 1650 | |
| AD-805624.1 | GGAUAAUGUCUUAUGUAAU | 1615 | | AUUACAUAAGACAUUAUCC | 1651 | 1219-1237 |
| AD-805636.1 | GGAUAAUGUCUUAUGUAAU | 1616 | | AUUACATAAGACAUUAUCC | 1652 | |
| AD-521840.1 | GGUUUUAUGAAAAGCUAGU | 1617 | 1753-1771 | ACUAGCUUUUCAUAAAACC | 1653 | |
| AD-805629.1 | GGUUUUAUGAAAAGCUAGU | 1618 | | ACUAGCUUUUCAUAAAACC | 1654 | 1753-1771 |
| AD-805641.1 | GGUUUUAUGAAAAGCUAGU | 1619 | | ACUAGCTUUUCAUAAAACC | 1655 | |
| AD-521409.1 | UGCUACCCAUUAGGAUAAU | 1620 | 1207-1225 | AUUAUCCUAAUGGGUAGCA | 1656 | |
| AD-805633.1 | UGCUACCCAUUAGGAUAAU | 1621 | | AUUAUCCUAAUGGGUAGCA | 1657 | 1207-1225 |
| AD-805645.1 | UGCUACCCAUUAGGAUAAU | 1622 | | AUUAUCCUAAUGGGUAGCA | 1658 | |
| AD-521486.1 | UGGUGACAUGGCUUCCAGU | 1623 | 1288-1306 | ACUGGAAGCCAUGUCACCA | 1659 | |
| AD-805627.1 | UGGUGACAUGGCUUCCAGU | 1624 | | ACUGGAAGCCAUGUCACCA | 1660 | 1288-1306 |
| AD-805639.1 | UGGUGACAUGGCUUCCAGU | 1625 | | ACUGGAAGCCAUGUCACCA | 1661 | |

TABLE 11

Modified Sense and Antisense Strand Sequences of PNPLA3 dsRNA Agents

| Duplex Name | Sense sequence | SEQ ID NO: | Antisense Sequence | SEQ ID NO: | mRNA Target Sequence | SEQ ID NO: |
|---|---|---|---|---|---|---|
| AD-521086.1 | ACAGGGAACCUCUACCUUUdTdT | 1662 | AAAGGUAGAGGUUCCCUGUdTdT | 1698 | ACAGGGAACCUCUACCUUC | 1734 |
| AD-805632.1 | ascsagggAfaCfCfUfcuaccuuuL96 | 1663 | asAfsaggUfagagguuCfcCfugu | 1699 | | |
| AD-805644.1 | ascsagggAfaCfCfUfcuaccuuuL96 | 1664 | asAfsaggUf(Agn)gag-guuCfcCfugu | 1700 | | |
| AD-521465.1 | CCAUUGCGAUUGUCCAGAUdTdT | 1665 | AUCUGGACAAUCGCAAUGGdTdT | 1701 | CCAUUGCGAUUGUCCAGAG | 1735 |
| AD-805631.1 | cscsauugCfgAfUfUfguccagauL96 | 1666 | asUfscugGfacaaucgCfaAfugg | 1702 | | |
| AD-805643.1 | cscsauugCfgAfUfUfguccagauL96 | 1667 | asUfscugGf(Agn)caaucgCfaAf-ugg | 1703 | | |
| AD-520902.1 | CGAAGUCGUGGAUGCCUUUdTdT | 1668 | AAAGGCAUCCACGACUUCGdTdT | 1704 | CGAAGUCGUGGAUGCCUUG | 1736 |
| AD-805634.1 | csgsaaguCfgUfGfGfaugccuuuL96 | 1669 | asAfsaggCfauccacgAfcUfucg | 1705 | | |
| AD-805646.1 | csgsaaguCfgUfGfGfaugccuuuL96 | 1670 | asAfsaggCf(Agn)uccacgAfcU-fucg | 1706 | | |
| AD-522140.1 | CUUUUUCACCUAACUAAAUdTdT | 1671 | AUUUAGUUAGGUGAAAAAGdTdT | 1707 | CUUUUUCACCUAACUAAAA | 1737 |
| AD-805635.1 | csusuuuuCfaCfCfUfaacuaaauL96 | 1672 | asUfsuuaGfuuaggugAfaAfaag | 1708 | | |
| AD-805647.1 | csusuuuuCfaCfCfUfaacuaaauL96 | 1673 | asUfsuuaGf(Tgn)uaggugAfaAf-aag | 1709 | | |
| AD-520903.1 | GAAGUCGUGGAUGCCUUGUdTdT | 1674 | ACAAGGCAUCCACGACUUCdTdT | 1710 | GAAGUCGUGGAUGCCUUGG | 1738 |
| AD-805628.1 | gsasagucGfuGfGfAfugccuuguL96 | 1675 | asCfsaagGfcauccacGfaCfuuc | 1711 | | |
| AD-805640.1 | gsasagucGfuGfGfAfugccuuguL96 | 1676 | asCfsaagGf(Cgn)auccacG-faCfuuc | 1712 | | |
| AD-520973.1 | GAGUGAGUGACAACGUACUdTdT | 1677 | AGUACGUUGUCACUCACUCdTdT | 1713 | GAGUGAGUGACAACGUACC | 1739 |
| AD-805625.1 | gsasgugaGfuGfAfCfaacguacuL96 | 1678 | asGfsuacGfuugucacUfcAfcuc | 1714 | | |
| AD-805637.1 | gsasgugaGfuGfAfCfaacguacuL96 | 1679 | asGfsuacGf(Tgn)ugucacUfcAf-cuc | 1715 | | |
| AD-521129.1 | GAUAUGCCUUCGAGGAUAUdTdT | 1680 | AUAUCCUCGAAGGCAUAUCdTdT | 1716 | GAUAUGCCUUCGAGGAUAU | 1740 |
| AD-805630.1 | gsasuaugCfcUfUfCfgaggauauL96 | 1681 | asUfsaucCfucgaaggCfaUfauc | 1717 | | |
| AD-805642.1 | gsasuaugCfcUfUfCfgaggauauL96 | 1682 | asUfsaucCf(Tgn)cgaaggCfaU-fauc | 1718 | | |
| AD-521124.1 | GGAGAGAUAUGCCUUCGAUdTdT | 1683 | AUCGAAGGCAUAUCUCUCCdTdT | 1719 | GGAGAGAUAUGCCUUCGAG | 1741 |
| AD-805626.1 | gsgsagagAfuAfUfGfccuucgauL96 | 1684 | asUfscgaAfggcauauCfuCfucc | 1720 | | |
| AD-805638.1 | gsgsagagAfuAfUfGfccuucgauL96 | 1685 | asUfscgaAf(Ggn)gcauauCfuCfucc | 1721 | | |
| AD-521420.1 | GGAUAAUGUCUUAUGUAAUdTdT | 1686 | AUUACAUAAGACAUUAUCCdTdT | 1722 | GGAUAAUGUCUUAUGUAAU | 1742 |
| AD-805624.1 | gsgsauaaUfgUfCfUfuauguaauL96 | 1687 | asUfsuacAfuaagacaUfuAfucc | 1723 | | |
| AD-805636.1 | gsgsauaaUfgUfCfUfuauguaauL96 | 1688 | asUfsuacAf(Tgn)aagacaUfuA-fucc | 1724 | | |
| AD-521840.1 | GGUUUUAUGAAAAGCUAGUdTdT | 1689 | ACUAGCUUUUCAUAAAACCdTdT | 1725 | GGUUUUAUGAAAAGCUAGG | 1743 |
| AD-805629.1 | gsgsuuuuAfuGfAfAfaagcuaguL96 | 1690 | asCfsuagCfuuuucauAfaAfacc | 1726 | | |
| AD-805641.1 | gsgsuuuuAfuGfAfAfaagcuaguL96 | 1691 | asCfsuagCf(Tgn)uuucauAfaAf-acc | 1727 | | |
| AD-521409.1 | UGCUACCCAUUAGGAUAAUdTdT | 1692 | AUUAUCCUAAUGGGUAGCAdTdT | 1728 | UGCUACCCAUUAGGAUAAU | 1744 |
| AD-805633.1 | usgscuacCfcAfUfUfaggauaauL96 | 1693 | asUfsuauCfcuaauggGfuAfgca | 1729 | | |

TABLE 11-continued

Modified Sense and Antisense Strand Sequences of PNPLA3 dsRNA Agents

| Duplex Name | Sense sequence | SEQ ID NO: | Antisense Sequence | SEQ ID NO: | mRNA Target Sequence | SEQ ID NO: |
|---|---|---|---|---|---|---|
| AD-805645.1 | usgscuacCfcAfUfUfaggauaauL96 | 1694 | asUfsuauCf(Cgn)uaauggGfuAfgca | 1730 | | |
| AD-521486.1 | UGGUGACAUGGCUUCCAGUdTdT | 1695 | ACUGGAAGCCAUGUCACCAdTdT | 1731 | UGGUGACAUGGCUUCCAGA | 1745 |
| AD-805627.1 | usgsgugaCfaUfGfGfcuuccaguL96 | 1696 | asCfsuggAfagccaugUfcAfcca | 1732 | | |
| AD-805639.1 | usgsgugaCfaUfGfGfcuuccaguL96 | 1697 | asCfsuggAf(Agn)gccaug-gUfcAfcca | 1733 | | |

TABLE 12

PNPLA3 Single Dose Screen in Cos-7 Cells (Human Dual-Luciferase psiCHECK2 vector)

| | 50 nM | | 10 nM | | 1 nM | | 0.1 nM | |
|---|---|---|---|---|---|---|---|---|
| DuplexID | % of Message Remaining | ST DEV | % of Message Remaining | ST DEV | % of Message Remaining | ST DEV | % of Message Remaining | ST DEV |
| AD-517197.1 | 17.0 | 7.0 | 15.4 | 3.4 | 41.0 | 13.9 | 77.8 | 16.2 |
| AD-516851.1 | 22.8 | 5.7 | 38.8 | 15 | 63.1 | 16.0 | 94.6 | 6.8 |
| AD-516748.1 | 26.8 | 15.5 | 61.7 | 10.7 | 59.0 | 38.3 | 95.4 | 27.2 |
| AD-517234.1 | 31.1 | 7.3 | 39.2 | 3 | 69.0 | 10.0 | 98.7 | 18.5 |
| AD-517354.1 | 32.0 | 7.4 | 42 | 9.8 | 102.2 | 29.0 | 98.4 | 15.4 |
| AD-517257.1 | 33.3 | 7.5 | 41.8 | 12.3 | 63.9 | 16.7 | 96.8 | 12.4 |
| AD-516739.1 | 33.3 | 10.2 | 50.7 | 9 | 85.6 | 21.7 | 110.6 | 13.9 |
| AD-517258.1 | 35.2 | 14.3 | 27.9 | 6.3 | 66.6 | 20.7 | 94.2 | 10.4 |
| AD-516629.1 | 36.5 | 8.3 | 47.6 | 13.2 | 94.6 | 9.0 | 126.1 | 22 |
| AD-516972.1 | 37.0 | 12.8 | 51.5 | 1.6 | 113.3 | 23.9 | 135.9 | 22.9 |
| AD-517623.1 | 37.5 | 12.5 | 55.9 | 7 | 76.6 | 25.6 | 96.9 | 12.7 |
| AD-516733.1 | 37.7 | 11.4 | 47.4 | 14.4 | 87.2 | 7.0 | 96.5 | 13 |
| AD-517985.1 | 40.4 | 9.2 | 51.2 | 10.3 | 78.6 | 13.9 | 98.4 | 14.4 |
| AD-516827.1 | 40.7 | 24.3 | 60.1 | 27.3 | 81.5 | 45.6 | 90.2 | 9.2 |
| AD-516917.1 | 42.1 | 13.8 | 35.1 | 8.3 | 69.4 | 15.4 | 99.6 | 22.2 |
| AD-516973.1 | 43.0 | 2.8 | 70.8 | 9.6 | 100.4 | 17.1 | 114.4 | 24.2 |
| AD-516978.1 | 44.3 | 18.5 | 46.1 | 18.4 | 76.2 | 6.9 | 99 | 13 |
| AD-517310.1 | 45.5 | 15.4 | 61.1 | 13 | 89.7 | 10.9 | 128.5 | 14.6 |
| AD-516828.1 | 46.2 | 12.1 | 55.8 | 12.6 | 95.9 | 15.9 | 120.4 | 30.5 |
| AD-517249.1 | 46.6 | 14.7 | 37.6 | 9 | 84.3 | 9.6 | 115.2 | 19.5 |
| AD-517196.1 | 47.5 | 14.0 | 55.2 | 7.3 | 82.3 | 13.5 | 116.3 | 22.9 |
| AD-517322.1 | 47.7 | 13.6 | 89.7 | 23.1 | 101.5 | 21.4 | 95.9 | 5.6 |
| AD-517319.1 | 48.4 | 29.0 | 70 | 24.7 | 90.6 | 15.9 | 125.1 | 5.6 |
| AD-516822.1 | 49.1 | 15.4 | 44.3 | 12.6 | 78.6 | 12.3 | 100 | 11.9 |
| AD-516826.1 | 50.6 | 17.1 | 73.2 | 20.1 | 90.1 | 4.2 | 115.9 | 13.8 |
| AD-516824.1 | 51.5 | 7.7 | 67.1 | 6.6 | 99.4 | 24.5 | 112.9 | 11.6 |
| AD-517517.1 | 51.5 | 11.0 | 80.6 | 16 | 79.8 | 17.5 | 113.5 | 7.3 |
| AD-517758.1 | 52.1 | 17.6 | 69.2 | 3.1 | 109.3 | 5.7 | 106.9 | 6.5 |
| AD-516940.1 | 52.6 | 27.2 | 82.7 | 27.6 | 79.6 | 15.9 | 88.6 | 15.7 |
| AD-517318.1 | 54.1 | 23.3 | 54.6 | 14.1 | 105.9 | 13.4 | 102.4 | 22.4 |
| AD-517321.1 | 54.3 | 22.5 | 63.6 | 32.3 | 92.5 | 6.7 | 98.5 | 11 |
| AD-516747.1 | 54.3 | 22.4 | 62.2 | 12.2 | 79.6 | 16.4 | 126.5 | 11.9 |
| AD-516737.1 | 54.4 | 4.2 | 74.3 | 19.7 | 76.8 | 6.9 | 93.4 | 13.4 |
| AD-516742.1 | 54.6 | 12.8 | 70.8 | 10 | 115.8 | 28.5 | 104 | 19.3 |
| AD-516977.1 | 55.6 | 20.2 | 63.4 | 15.1 | 83.6 | 11.5 | 97.4 | 22.3 |
| AD-516823.1 | 56.5 | 24.3 | 65.8 | 16.6 | 85.9 | 18.5 | 90.8 | 8.6 |
| AD-516871.1 | 56.9 | 17.2 | 62.6 | 9.3 | 101.4 | 18.0 | 113.7 | 18.5 |
| AD-516771.1 | 57.1 | 8.8 | 66.2 | 10.6 | 82.1 | 9.6 | 100.8 | 19.5 |
| AD-517757.1 | 57.5 | 9.1 | 72.6 | 9 | 100.2 | 5.8 | 97.6 | 7.1 |
| AD-516745.1 | 58.3 | 31.2 | 60.6 | 12.4 | 91.2 | 11.5 | 133 | 33.3 |
| AD-517830.1 | 60.1 | 18.0 | 75.2 | 11.8 | 85.7 | 5.7 | 92 | 13 |
| AD-516970.1 | 60.7 | 9.9 | 81.7 | 18.6 | 104.2 | 5.3 | 100.2 | 4.8 |
| AD-517768.1 | 61.9 | 5.8 | 89.5 | 20 | 109.8 | 32.6 | 113.8 | 31.4 |
| AD-517259.1 | 62.4 | 29.7 | 73.9 | 13.4 | 94.2 | 26.1 | 95.2 | 27.4 |
| AD-516979.1 | 65.1 | 18.5 | 70.3 | 34.6 | 92.6 | 17.3 | 101.3 | 15.6 |
| AD-516971.1 | 65.2 | 39.8 | 81.4 | 26.5 | 107.9 | 8.6 | 126 | 56.3 |
| AD-517838.1 | 66.5 | 7.3 | 57 | 12 | 96.9 | 21.2 | 113.8 | 8.1 |
| AD-516743.1 | 66.5 | 10.8 | 76.9 | 20.6 | 74.9 | 9.3 | 110.1 | 14.2 |
| AD-516980.1 | 66.8 | 32.1 | 73.1 | 12.6 | 110.6 | 4.4 | 111.4 | 5.9 |
| AD-517771.1 | 67.7 | 18.0 | 77.6 | 20.1 | 91.0 | 21.5 | 99 | 6 |
| AD-516772.1 | 69.8 | 9.1 | 74 | 10.6 | 111.8 | 30.0 | 103.9 | 17.8 |

TABLE 12-continued

PNPLA3 Single Dose Screen in Cos-7 Cells (Human Dual-Luciferase psiCHECK2 vector)

| | 50 nM | | 10 nM | | 1 nM | | 0.1 nM | |
|---|---|---|---|---|---|---|---|---|
| DuplexID | % of Message Remaining | ST DEV | % of Message Remaining | ST DEV | % of Message Remaining | ST DEV | % of Message Remaining | ST DEV |
| AD-517836.1 | 69.9 | 40.1 | 69 | 20.6 | 97.2 | 32.9 | 115.4 | 22.5 |
| AD-516741.1 | 69.9 | 24.6 | 96.6 | 22.8 | 100.4 | 13.9 | 125.8 | 20.3 |
| AD-517353.1 | 70.7 | 27.0 | 93.2 | 10.7 | 98.8 | 21.7 | 116 | 24.8 |
| AD-517979.1 | 72.5 | 10.1 | 88 | 26.7 | 113.4 | 6.8 | 139 | 10.6 |
| AD-516937.1 | 73.5 | 14.3 | 71.5 | 12.7 | 92.2 | 18.2 | 115.9 | 12.9 |
| AD-516976.1 | 73.5 | 38.4 | 59.6 | 12.7 | 73.5 | 4.8 | 90 | 12.7 |
| AD-516872.1 | 73.6 | 37.1 | 56.2 | 10.9 | 87.7 | 20.6 | 101.1 | 19 |
| AD-517256.1 | 73.9 | 24.1 | 98.1 | 8.7 | 105.0 | 10.9 | 99.6 | 6.7 |
| AD-516825.1 | 74.1 | 11.0 | 84.8 | 25.3 | 100.9 | 25.6 | 102 | 13.4 |
| AD-516735.1 | 74.5 | 7.3 | 98.9 | 6.8 | 95.4 | 12.5 | 98.8 | 10.7 |
| AD-516588.1 | 75.2 | 28.1 | 88.5 | 13 | 112.2 | 18.2 | 122.4 | 25.5 |
| AD-516738.1 | 75.6 | 15.0 | 85.1 | 17 | 89.8 | 27.8 | 131.4 | 32.6 |
| AD-517314.1 | 76.8 | 24.6 | 69.7 | 18 | 81.0 | 16.6 | 93.2 | 10.4 |
| AD-517805.1 | 76.9 | 9.4 | 70.6 | 9 | 112.4 | 26.3 | 96.4 | 17.7 |
| AD-517685.1 | 78.3 | 22.9 | 64.6 | 6.6 | 98.6 | 12.9 | 108.2 | 19.8 |
| AD-517831.1 | 78.8 | 13.5 | 91.4 | 18.1 | 118.3 | 21.8 | 131.6 | 23.2 |
| AD-516830.1 | 78.9 | 9.0 | 81.5 | 22.5 | 91.1 | 17.5 | 108 | 32.5 |
| AD-517837.1 | 79.5 | 53.8 | 68.2 | 22.7 | 97.8 | 33.2 | 96.8 | 12.9 |
| AD-517633.1 | 81.1 | 21.5 | 89.9 | 10.7 | 91.2 | 17.6 | 93.9 | 9.4 |
| AD-516855.1 | 81.3 | 21.1 | 74.4 | 11.6 | 93.0 | 19.8 | 111 | 9.5 |
| AD-516688.1 | 83.0 | 33.6 | 69.9 | 9.3 | 80.1 | 10.5 | 106.2 | 13.8 |
| AD-516630.1 | 86.4 | 33.1 | 82 | 22.2 | 69.8 | 23.2 | 92 | 15.4 |
| AD-516835.1 | 86.8 | 17.0 | 70.5 | 13.3 | 103.1 | 17.2 | 101.4 | 8.2 |
| AD-516832.1 | 87.4 | 14.5 | 100 | 20.5 | 108.9 | 11.7 | 127.3 | 24.9 |
| AD-517834.1 | 88.9 | 21.8 | 73.9 | 9.1 | 90.4 | 13.8 | 79.3 | 8.5 |
| AD-516734.1 | 89.7 | 19.7 | 88.3 | 12.6 | 98.6 | 5.2 | 103.4 | 23.2 |
| AD-517228.1 | 89.7 | 14.3 | 83.5 | 17.5 | 101.4 | 19.9 | 118.8 | 17 |
| AD-516736.1 | 93.2 | 12.9 | 90.2 | 19.6 | 115.9 | 14.4 | 106.7 | 5.4 |
| AD-517646.1 | 93.8 | 38.8 | 71.9 | 18.9 | 104.5 | 24.7 | 100.1 | 10.7 |
| AD-517744.1 | 95.6 | 10.2 | 80.5 | 10.4 | 85.3 | 14.9 | 99.9 | 16 |
| AD-517509.1 | 96.7 | 20.8 | 108 | 11.2 | 95.6 | 15.9 | 124.2 | 20.1 |
| AD-517746.1 | 97.6 | 13.6 | 79.3 | 19.8 | 91.4 | 16.7 | 94 | 17.1 |
| AD-516752.1 | 99.9 | 29.7 | 94 | 25.5 | 105.4 | 18.9 | 117.7 | 13.1 |
| AD-516746.1 | 100.3 | 19.5 | 80.5 | 14.1 | 100.5 | 22.4 | 116.2 | 6.8 |
| AD-517227.1 | 102.2 | 25.7 | 79.3 | 10 | 90.6 | 22.5 | 115.3 | 21.8 |
| AD-516751.1 | 54.2 | 31.7 | 51.8 | 11.2 | 91.2 | 8.5 | 125.7 | 19.2 |
| AD-517042.1 | 102.4 | 31.9 | 64.7 | 8.2 | 90.2 | 6.3 | 113.1 | 19.6 |
| AD-517571.1 | 85.2 | 54.8 | 88.7 | 17.9 | 87.5 | 8.1 | 93.3 | 6.4 |

TABLE 13

PNPLA3 Single Dose Screen in Cos-7 Cells (Human Dual-Luciferase psiCHECK2 vector)

| | 50 nM | | 10 nM | | 1 nM | | 0.1 nM | |
|---|---|---|---|---|---|---|---|---|
| DuplexID | % of Message Remaining | ST DEV | % of Message Remaining | ST DEV | % of Message Remaining | ST DEV | % of Message Remaining | ST DEV |
| AD-67605.6 | 7.2 | 7.9 | 34.8 | 14.9 | 66.5 | 24.1 | 93.0 | 19.7 |
| AD-520101.1 | 13.0 | 10.3 | 39.4 | 18.8 | 77.1 | 12.9 | 74.1 | 23.0 |
| AD-520098.1 | 18.5 | 5.3 | 65.4 | 41.4 | 68.0 | 30.3 | 114.7 | 42.8 |
| AD-67575.6 | 19.3 | 6.6 | 33.8 | 23.9 | 89.4 | 29.7 | 105.2 | 38.7 |
| AD-520467.1 | 20.5 | 13.6 | 46.8 | 19.1 | 72.7 | 12.1 | 133.1 | 81.1 |
| AD-520064.1 | 21.2 | 4.3 | 29.5 | 9.0 | 58.8 | 6.1 | 110.0 | 23.0 |
| AD-520099.1 | 21.2 | 13.1 | 64.7 | 9.7 | 61.3 | 22.5 | 100.6 | 38.3 |
| AD-520466.1 | 22.2 | 10.3 | 52.4 | 8.8 | 77.4 | 24.1 | 141.2 | 54.5 |
| AD-519351.1 | 22.9 | 18.1 | 28.3 | 6.7 | 50.3 | 18.5 | 91.2 | 43.4 |
| AD-520065.1 | 23.4 | 21.2 | 49.6 | 5.2 | 55.3 | 24.7 | 90.4 | 11.3 |
| AD-520069.1 | 23.8 | 18.5 | 65.1 | 5.3 | 98.6 | 21.1 | 134.8 | 27.2 |
| AD-519828.1 | 23.9 | 23.3 | 41.5 | 24.7 | 100.1 | 24.7 | 99.6 | 21.4 |
| AD-520035.1 | 25.8 | 18.4 | 57.3 | 24.0 | 106.9 | 34.4 | 100.2 | 27.7 |
| AD-520067.1 | 28.5 | 24.7 | 38.1 | 17.6 | 63.1 | 20.7 | 96.6 | 20.9 |
| AD-75289.2 | 28.5 | 16.3 | 44.1 | 20.5 | 81.8 | 18.6 | 82.1 | 7.3 |
| AD-520125.1 | 29.4 | 15.6 | 57.1 | 10.4 | 76.6 | 14.5 | 155.3 | 45.2 |
| AD-520018.1 | 29.9 | 6.3 | 32.0 | 16.0 | 66.1 | 19.8 | 101.4 | 39.1 |

TABLE 13-continued

PNPLA3 Single Dose Screen in Cos-7 Cells (Human Dual-Luciferase psiCHECK2 vector)

| DuplexID | 50 nM % of Message Remaining | 50 nM ST DEV | 10 nM % of Message Remaining | 10 nM ST DEV | 1 nM % of Message Remaining | 1 nM ST DEV | 0.1 nM % of Message Remaining | 0.1 nM ST DEV |
|---|---|---|---|---|---|---|---|---|
| AD-520062.1 | 31.4 | 9.1 | 53.5 | 36.7 | 66.8 | 23.2 | 74.9 | 14.7 |
| AD-519754.1 | 32.6 | 7.3 | 86.3 | 24.9 | 98.3 | 27.4 | 99.9 | 16.2 |
| AD-520097.1 | 35.2 | 16.8 | 38.7 | 9.5 | 95.2 | 34.8 | 123.6 | 33.6 |
| AD-520352.1 | 37.0 | 14.5 | 63.4 | 19.8 | 77.9 | 26.9 | 105.2 | 25.3 |
| AD-519755.1 | 38.8 | 21.4 | 48.7 | 19.1 | 101.4 | 25.3 | 130.8 | 48.1 |
| AD-520063.1 | 40.2 | 12.8 | 58.5 | 39.1 | 56.3 | 19.0 | 107.1 | 24.9 |
| AD-520066.1 | 43.2 | 13.7 | 40.5 | 11.4 | 58.2 | 18.3 | 115.4 | 46.6 |
| AD-520068.1 | 46.8 | 22.3 | 53.0 | 43.8 | 68.9 | 41.3 | 90.5 | 40.0 |
| AD-520465.1 | 66.5 | 14.2 | 101.1 | 35.3 | 71.4 | 32.2 | 88.7 | 12.6 |
| AD-519592.1 | 67.2 | 13.0 | 99.4 | 40.7 | 69.9 | 16.9 | 87.1 | 23.7 |
| AD-519591.1 | 75.9 | 33.3 | 79.8 | 23.0 | 95.9 | 36.6 | 89.6 | 33.9 |

TABLE 14

PNPLA3 Single Dose Screen in Hep3B Cells

| Duplex | Avg % of Message Remaining | SD | Dose (nM) |
|---|---|---|---|
| AD-519351.1 | 18.91743 | 1.592235 | 50 |
| AD-519591.1 | 30.15831 | 4.008696 | 50 |
| AD-519592.1 | 49.60929 | 3.258342 | 50 |
| AD-519754.1 | 29.95629 | 3.489596 | 50 |
| AD-519755.1 | 32.7814 | 3.836985 | 50 |
| AD-519828.1 | 25.91768 | 2.010603 | 50 |
| AD-520018.1 | 17.85763 | 0.704719 | 50 |
| AD-520035.1 | 13.40537 | 0.824367 | 50 |
| AD-520062.1 | 16.07361 | 2.76391 | 50 |
| AD-520063.1 | 42.26994 | 7.472034 | 50 |
| AD-520064.1 | 32.07188 | 6.038421 | 50 |
| AD-520065.1 | 41.04576 | 7.358829 | 50 |
| AD-520066.1 | 49.84015 | 4.399835 | 50 |
| AD-520067.1 | 32.29406 | 2.439182 | 50 |
| AD-520068.1 | 34.46787 | 3.933021 | 50 |
| AD-520069.1 | 50.74699 | 7.696823 | 50 |
| AD-520097.1 | 37.05357 | 3.157405 | 50 |
| AD-520098.1 | 43.45243 | 7.096347 | 50 |
| AD-520099.1 | 34.3067 | 6.026941 | 50 |
| AD-520101.1 | 34.10031 | 2.946968 | 50 |
| AD-520125.1 | 37.9648 | 5.052388 | 50 |
| AD-520352.1 | 55.35492 | 5.581261 | 50 |
| AD-520465.1 | 116.2403 | 11.93776 | 50 |
| AD-520466.1 | 50.49998 | 5.242516 | 50 |
| AD-520467.1 | 57.64928 | 4.998672 | 50 |
| AD-67575.6 | 32.8979 | 5.107761 | 50 |
| AD-67605.6 | 30.30416 | 5.607134 | 50 |
| AD-75289.2 | 37.28977 | 7.002537 | 50 |
| AD-519351.1 | 28.011 | 2.78131 | 10 |
| AD-519591.1 | 48.39234 | 9.625783 | 10 |
| AD-519592.1 | 67.92064 | 14.89226 | 10 |
| AD-519754.1 | 51.1618 | 7.649766 | 10 |
| AD-519755.1 | 41.00894 | 4.838157 | 10 |
| AD-519828.1 | 39.08326 | 3.07126 | 10 |
| AD-520018.1 | 14.21871 | 7.205605 | 10 |
| AD-520035.1 | 17.60407 | 3.934564 | 10 |
| AD-520062.1 | 25.84533 | 3.490245 | 10 |
| AD-520063.1 | 42.59087 | 3.989656 | 10 |
| AD-520064.1 | 32.13541 | 3.984171 | 10 |
| AD-520065.1 | 34.56078 | 6.902658 | 10 |
| AD-520066.1 | 43.89564 | 5.960707 | 10 |
| AD-520067.1 | 30.99356 | 5.829848 | 10 |
| AD-520068.1 | 44.00221 | 5.902595 | 10 |
| AD-520069.1 | 51.01245 | 6.208729 | 10 |
| AD-520097.1 | 44.51291 | 6.137725 | 10 |
| AD-520098.1 | 45.04234 | 3.412759 | 10 |
| AD-520099.1 | 39.05479 | 4.499439 | 10 |
| AD-520101.1 | 38.56051 | 7.725309 | 10 |
| AD-520125.1 | 54.31024 | 10.76057 | 10 |
| AD-520352.1 | 51.88458 | 9.725295 | 10 |
| AD-520465.1 | 93.6487 | 8.10188 | 10 |
| AD-520466.1 | 60.38535 | 6.422916 | 10 |
| AD-520467.1 | 50.73771 | 8.167229 | 10 |
| AD-67575.6 | 42.36839 | 6.376496 | 10 |
| AD-67605.6 | 32.93356 | 4.534181 | 10 |
| AD-75289.2 | 35.10034 | 4.252315 | 10 |
| AD-519351.1 | 38.91029 | 6.73621 | 1 |
| AD-519591.1 | 72.03301 | 8.409019 | 1 |
| AD-519592.1 | 91.99647 | 6.557726 | 1 |
| AD-519754.1 | 71.39233 | 10.16091 | 1 |
| AD-519755.1 | 48.64478 | 8.703204 | 1 |
| AD-519828.1 | 56.57794 | 8.681994 | 1 |
| AD-520018.1 | 43.24255 | 12.35058 | 1 |
| AD-520035.1 | 41.61261 | 9.606674 | 1 |
| AD-520062.1 | 41.56298 | 7.015498 | 1 |
| AD-520063.1 | 50.9099 | 8.41448 | 1 |
| AD-520064.1 | 49.60309 | 8.547469 | 1 |
| AD-520065.1 | 51.99888 | 13.42055 | 1 |
| AD-520066.1 | 58.14913 | 6.189735 | 1 |
| AD-520067.1 | 47.67786 | 4.442494 | 1 |
| AD-520068.1 | 68.81371 | 17.00633 | 1 |
| AD-520069.1 | 58.92955 | 8.034131 | 1 |
| AD-520097.1 | 53.79314 | 4.302369 | 1 |
| AD-520098.1 | 62.39227 | 4.285866 | 1 |
| AD-520099.1 | 74.81884 | 4.665135 | 1 |
| AD-520101.1 | 59.49561 | 9.59846 | 1 |
| AD-520125.1 | 60.19627 | 4.672244 | 1 |
| AD-520352.1 | 79.06617 | 11.33413 | 1 |
| AD-520465.1 | 103.3435 | 26.3229 | 1 |
| AD-520466.1 | 86.98648 | 21.00735 | 1 |
| AD-520467.1 | 81.16465 | 23.24505 | 1 |
| AD-67575.6 | 59.97269 | 7.272857 | 1 |
| AD-67605.6 | 52.64283 | 5.165939 | 1 |
| AD-75289.2 | 73.81446 | 13.1944 | 1 |
| AD-519351.1 | 58.00814 | 5.565421 | 0.1 |
| AD-519591.1 | 88.58883 | 14.40971 | 0.1 |
| AD-519592.1 | 100.9556 | 9.227538 | 0.1 |
| AD-519754.1 | 93.4398 | 15.32662 | 0.1 |
| AD-519755.1 | 79.44622 | 3.664871 | 0.1 |
| AD-519828.1 | 93.29187 | 9.598122 | 0.1 |
| AD-520018.1 | 67.61844 | 8.626892 | 0.1 |
| AD-520035.1 | 60.53901 | 5.277965 | 0.1 |
| AD-520062.1 | 72.05043 | 8.551113 | 0.1 |
| AD-520063.1 | 79.2352 | 11.96642 | 0.1 |

TABLE 14-continued

PNPLA3 Single Dose Screen in Hep3B Cells

| Duplex | Avg % of Message Remaining | SD | Dose (nM) |
|---|---|---|---|
| AD-520064.1 | 64.04505 | 10.59475 | 0.1 |
| AD-520065.1 | 74.87369 | 15.32438 | 0.1 |
| AD-520066.1 | 77.48361 | 11.28607 | 0.1 |
| AD-520067.1 | 79.16226 | 8.228879 | 0.1 |
| AD-520068.1 | 98.42636 | 29.19873 | 0.1 |
| AD-520069.1 | 81.92734 | 10.02953 | 0.1 |
| AD-520097.1 | 78.17625 | 13.3457 | 0.1 |
| AD-520098.1 | 81.87427 | 12.05935 | 0.1 |
| AD-520099.1 | 87.99157 | 22.24171 | 0.1 |
| AD-520101.1 | 90.27513 | 9.407839 | 0.1 |
| AD-520125.1 | 91.10768 | 17.63111 | 0.1 |
| AD-520352.1 | 99.6731 | 4.089456 | 0.1 |
| AD-520465.1 | 89.46856 | 1.073905 | 0.1 |
| AD-520466.1 | 94.49258 | 4.863811 | 0.1 |
| AD-520467.1 | 91.43145 | 12.05283 | 0.1 |
| AD-67575.6 | 86.88788 | 17.45404 | 0.1 |
| AD-67605.6 | 89.55684 | 14.21808 | 0.1 |
| AD-75289.2 | 95.69357 | 10.92256 | 0.1 |

TABLE 15

PNPLA3 Single Dose Screen in Cos-7 Cells
(Human Dual-Luciferase psiCHECK2 vector)

| | 50 nM | |
|---|---|---|
| DuplexID | % of Message Remaining | ST DEV |
| AD-521420.1 | 12.6 | 5.2 |
| AD-520973.1 | 13.0 | 9.6 |
| AD-521124.1 | 15.6 | 12.7 |
| AD-521486.1 | 17.6 | 4.6 |
| AD-520903.1 | 17.6 | 14.3 |
| AD-520972.1 | 17.6 | 7.4 |
| AD-521421.1 | 17.7 | 6.7 |
| AD-521840.1 | 17.8 | 3.3 |
| AD-521003.1 | 18.1 | 6.4 |
| AD-521129.1 | 18.9 | 5.7 |
| AD-521465.1 | 19.2 | 10.1 |
| AD-521086.1 | 19.5 | 7.9 |
| AD-521409.1 | 20.5 | 12.1 |
| AD-522178.1 | 20.6 | 11.7 |
| AD-520974.1 | 22.0 | 8.0 |
| AD-520902.1 | 24.1 | 9.4 |
| AD-522140.1 | 24.3 | 4.9 |
| AD-521410.1 | 25.6 | 7.2 |
| AD-522548.1 | 26.1 | 3.8 |
| AD-521002.1 | 26.1 | 9.0 |
| AD-522176.1 | 27.2 | 5.2 |
| AD-520926.1 | 28.1 | 12.4 |
| AD-521895.1 | 28.3 | 7.9 |
| AD-521499.1 | 29.1 | 4.9 |
| AD-521466.1 | 29.2 | 6.9 |
| AD-521140.1 | 29.5 | 9.4 |
| AD-520892.1 | 30.1 | 11.7 |
| AD-520976.1 | 30.5 | 13.4 |
| AD-521457.1 | 30.6 | 11.5 |
| AD-521127.1 | 30.7 | 7.8 |
| AD-522145.1 | 31.2 | 10.2 |
| AD-520984.1 | 31.2 | 9.1 |
| AD-521997.1 | 32.2 | 15.4 |
| AD-522174.1 | 32.8 | 9.7 |
| AD-522545.1 | 33.6 | 7.1 |
| AD-521979.1 | 33.8 | 6.7 |
| AD-520891.1 | 33.9 | 14.8 |
| AD-521833.1 | 34.3 | 9.6 |
| AD-521461.1 | 35.0 | 22.6 |
| AD-521386.1 | 35.0 | 15.0 |

TABLE 15-continued

PNPLA3 Single Dose Screen in Cos-7 Cells
(Human Dual-Luciferase psiCHECK2 vector)

| | 50 nM | |
|---|---|---|
| DuplexID | % of Message Remaining | ST DEV |
| AD-521123.1 | 35.1 | 23.9 |
| AD-520899.1 | 35.9 | 14.2 |
| AD-521089.1 | 36.9 | 26.5 |
| AD-521407.1 | 37.3 | 15.3 |
| AD-520898.1 | 38.6 | 18.6 |
| AD-521378.1 | 38.7 | 18.6 |
| AD-521500.1 | 38.8 | 17.7 |
| AD-521798.1 | 39.4 | 14.3 |
| AD-521902.1 | 39.6 | 10.0 |
| AD-521896.1 | 39.8 | 18.4 |
| AD-521989.1 | 39.8 | 15.6 |
| AD-520896.1 | 40.7 | 13.9 |
| AD-69024.2 | 41.1 | 8.3 |
| AD-522146.1 | 41.6 | 9.7 |
| AD-522432.1 | 41.9 | 18.9 |
| AD-521020.1 | 42.2 | 11.6 |
| AD-521668.1 | 42.3 | 8.2 |
| AD-522097.1 | 43.0 | 12.5 |
| AD-520999.1 | 43.9 | 18.0 |
| AD-521832.1 | 44.4 | 10.4 |
| AD-520894.1 | 44.7 | 10.5 |
| AD-522144.1 | 45.0 | 22.2 |
| AD-521408.1 | 45.2 | 24.2 |
| AD-521128.1 | 45.7 | 9.9 |
| AD-521980.1 | 45.8 | 5.0 |
| AD-521406.1 | 46.5 | 17.9 |
| AD-521131.1 | 46.8 | 21.4 |
| AD-521909.1 | 47.1 | 28.4 |
| AD-521954.1 | 47.4 | 7.8 |
| AD-520872.1 | 47.7 | 19.8 |
| AD-522142.1 | 48.2 | 22.3 |
| AD-520994.1 | 48.8 | 6.2 |
| AD-520886.1 | 50.0 | 20.3 |
| AD-521987.1 | 50.5 | 17.9 |
| AD-521988.1 | 50.8 | 6.9 |
| AD-520785.1 | 51.2 | 11.0 |
| AD-521919.1 | 51.4 | 18.6 |
| AD-521121.1 | 51.7 | 15.0 |
| AD-522202.1 | 53.1 | 17.3 |
| AD-521130.1 | 54.5 | 17.6 |
| AD-521908.1 | 55.1 | 33.8 |
| AD-522173.1 | 55.1 | 15.5 |
| AD-521785.1 | 56.1 | 13.2 |
| AD-520890.1 | 56.3 | 19.6 |
| AD-520978.1 | 56.5 | 26.3 |
| AD-521744.1 | 57.5 | 6.9 |
| AD-521021.1 | 58.1 | 4.4 |
| AD-521197.1 | 59.2 | 18.9 |
| AD-521379.1 | 59.7 | 42.4 |
| AD-520925.1 | 60.6 | 12.4 |
| AD-520888.1 | 60.8 | 24.3 |
| AD-520975.1 | 66.0 | 16.0 |
| AD-521666.1 | 66.3 | 30.6 |
| AD-521922.1 | 66.5 | 19.7 |
| AD-521986.1 | 67.3 | 21.9 |
| AD-521915.1 | 67.6 | 21.7 |
| AD-520897.1 | 69.4 | 28.1 |
| AD-520889.1 | 73.3 | 27.6 |
| AD-520885.1 | 74.2 | 37.3 |
| AD-521469.1 | 75.6 | 16.4 |
| AD-521674.1 | 78.4 | 26.1 |
| AD-521983.1 | 80.9 | 26.8 |
| AD-521385.1 | 82.8 | 18.7 |
| AD-521937.1 | 84.8 | 29.7 |
| AD-522141.1 | 87.4 | 22.7 |
| AD-522143.1 | 90.7 | 25.1 |
| AD-521669.1 | 103.8 | 12.8 |

TABLE 16

PNPLA3 Single Dose Screen in Cos-7 Cells (Human Dual-Luciferase psiCHECK2 vector)

| DuplexID | 10 nM % of Message Remaining | ST DEV | 1 nM % of Message Remaining | ST DEV | 0.1 nM % of Message Remaining | ST DEV |
|---|---|---|---|---|---|---|
| AD-520062.3 | 32.2 | 7.2 | 74.3 | 13.0 | 85.9 | 14.6 |
| AD-520060.1 | 35.5 | 17.3 | 65.8 | 8.7 | 81.0 | 14.5 |
| AD-520064.3 | 20.4 | 3.3 | 49.2 | 7.7 | 73.6 | 8.0 |
| AD-518983.1 | 64.3 | 5.2 | 91.2 | 20.1 | 89.9 | 26.0 |
| AD-520061.1 | 23.0 | 5.7 | 46.1 | 4.9 | 84.5 | 13.2 |
| AD-520063.2 | 37.5 | 9.8 | 76.0 | 9.4 | 84.4 | 9.9 |
| AD-519615.1 | 44.2 | 13.4 | 81.4 | 19.8 | 93.9 | 41.4 |
| AD-519757.1 | 42.0 | 6.3 | 84.4 | 11.8 | 90.2 | 13.3 |
| AD-519329.1 | 53.6 | 11.7 | 86.2 | 13.3 | 90.2 | 10.7 |
| AD-519324.1 | 34.9 | 9.9 | 76.4 | 12.0 | 94.6 | 21.5 |
| AD-518811.1 | 60.5 | 17.1 | 90.0 | 27.0 | 94.6 | 7.0 |
| AD-520059.1 | 40.9 | 5.0 | 78.3 | 16.3 | 96.9 | 7.7 |
| AD-519616.1 | 53.2 | 14.0 | 86.4 | 15.9 | 72.7 | 8.3 |
| AD-518655.1 | 41.3 | 0.5 | 92.0 | 12.2 | 106.1 | 16.9 |
| AD-519617.1 | 51.8 | 14.3 | 87.1 | 17.2 | 92.2 | 11.4 |
| AD-519307.1 | 32.3 | 8.7 | 66.2 | 11.2 | 94.9 | 14.7 |
| AD-520065.3 | 34.1 | 4.1 | 61.3 | 15.7 | 94.1 | 12.5 |
| AD-519323.1 | 32.0 | 10.9 | 48.0 | 8.9 | 68.7 | 10.9 |
| AD-519331.1 | 47.8 | 14.6 | 106.6 | 23.3 | 92.0 | 8.0 |
| AD-518922.1 | 54.3 | 11.2 | 95.1 | 20.4 | 106.8 | 7.7 |
| AD-519339.1 | 37.6 | 9.6 | 60.4 | 22.4 | 81.9 | 17.8 |
| AD-67552.2 | 67.3 | 7.3 | 92.6 | 24.3 | 100.9 | 18.4 |
| AD-519756.1 | 49.8 | 12.6 | 91.6 | 17.1 | 101.2 | 6.3 |
| AD-519333.1 | 45.1 | 8.0 | 88.4 | 8.4 | 78.8 | 20.1 |
| AD-519612.1 | 73.4 | 12.1 | 88.1 | 18.7 | 89.4 | 21.7 |
| AD-519762.1 | 42.0 | 7.3 | 84.9 | 21.9 | 99.1 | 10.2 |
| AD-75265.3 | 47.2 | 11.9 | 89.2 | 23.8 | 88.3 | 7.9 |
| AD-67554.5 | 47.8 | 7.3 | 66.0 | 11.0 | 67.2 | 10.6 |
| AD-518928.1 | 39.2 | 11.0 | 87.7 | 13.2 | 93.2 | 21.4 |
| AD-519578.1 | 94.4 | 24.3 | 105.6 | 14.6 | 92.6 | 12.0 |
| AD-75277.3 | 44.7 | 8.3 | 78.5 | 13.7 | 100.4 | 15.2 |
| AD-519317.1 | 69.1 | 19.2 | 88.7 | 15.7 | 102.9 | 20.2 |
| AD-67581.5 | 72.9 | 15.9 | 109.6 | 26.6 | 105.3 | 11.4 |
| AD-519753.1 | 53.1 | 13.6 | 89.6 | 15.3 | 103.0 | 16.2 |
| AD-518701.1 | 42.9 | 12.5 | 79.1 | 15.0 | 99.8 | 19.4 |
| AD-519752.1 | 69.5 | 24.6 | 80.7 | 17.2 | 94.1 | 8.3 |
| AD-519328.1 | 40.9 | 8.5 | 73.8 | 15.7 | 84.9 | 7.7 |
| AD-519322.1 | 55.7 | 13.6 | 98.3 | 5.1 | 103.9 | 13.1 |
| AD-519911.1 | 35.0 | 7.9 | 69.8 | 18.3 | 87.2 | 8.7 |
| AD-519029.1 | 79.1 | 20.1 | 122.2 | 10.1 | 95.6 | 17.3 |
| AD-519913.1 | 99.4 | 16.9 | 95.1 | 15.7 | 105.5 | 32.2 |
| AD-518924.1 | 83.2 | 11.9 | 89.6 | 14.5 | 87.4 | 11.7 |
| AD-519766.1 | 57.7 | 22.1 | 73.9 | 17.8 | 95.2 | 14.4 |
| AD-519069.1 | 57.9 | 17.5 | 96.2 | 5.7 | 91.2 | 19.5 |
| AD-519614.1 | 64.9 | 8.9 | 99.4 | 20.3 | 100.9 | 17.1 |
| AD-519618.1 | 67.5 | 16.8 | 99.9 | 16.1 | 93.5 | 13.3 |
| AD-519326.1 | 75.6 | 18.3 | 95.8 | 12.7 | 94.8 | 23.2 |
| AD-518920.1 | 82.8 | 16.5 | 93.8 | 12.4 | 100.8 | 13.4 |
| AD-519760.1 | 27.5 | 7.6 | 79.0 | 14.0 | 80.3 | 17.9 |
| AD-518813.1 | 51.7 | 19.6 | 112.4 | 8.9 | 97.9 | 19.1 |
| AD-519396.1 | 55.9 | 9.5 | 81.0 | 17.7 | 106.8 | 15.1 |
| AD-519935.1 | 55.7 | 12.5 | 103.7 | 6.8 | 95.0 | 22.2 |
| AD-519758.1 | 45.5 | 20.8 | 85.1 | 18.2 | 96.4 | 27.4 |
| AD-518831.1 | 48.2 | 7.4 | 74.1 | 13.5 | 94.7 | 5.8 |
| AD-518923.1 | 42.9 | 6.0 | 68.5 | 9.3 | 93.0 | 18.0 |
| AD-519755.2 | 39.5 | 8.8 | 61.5 | 15.2 | 106.9 | 15.0 |
| AD-520116.1 | 36.8 | 3.8 | 75.9 | 18.4 | 101.4 | 23.0 |
| AD-519093.1 | 61.5 | 10.0 | 84.2 | 27.7 | 81.5 | 17.9 |
| AD-67588.2 | 61.3 | 5.7 | 97.6 | 13.0 | 86.5 | 12.2 |
| AD-519754.3 | 52.3 | 9.4 | 83.0 | 19.3 | 111.7 | 6.7 |
| AD-519308.1 | 68.0 | 5.3 | 95.7 | 18.5 | 115.4 | 18.7 |
| AD-519759.1 | 46.6 | 9.8 | 87.3 | 12.5 | 79.0 | 11.5 |
| AD-519763.1 | 46.3 | 13.4 | 83.5 | 25.2 | 101.6 | 10.6 |
| AD-519327.1 | 68.6 | 16.9 | 98.2 | 23.1 | 103.5 | 9.0 |
| AD-519761.1 | 18.5 | 1.5 | 67.3 | 17.5 | 83.3 | 16.3 |
| AD-518702.1 | 48.1 | 6.4 | 81.8 | 15.2 | 76.4 | 21.1 |
| AD-519094.1 | 52.5 | 11.0 | 97.8 | 5.3 | 95.7 | 22.7 |
| AD-518832.1 | 57.1 | 17.0 | 84.6 | 8.0 | 87.6 | 16.3 |
| AD-519767.1 | 66.8 | 16.3 | 93.7 | 22.7 | 86.8 | 12.2 |
| AD-518917.1 | 69.6 | 9.7 | 93.3 | 17.5 | 82.3 | 8.7 |
| AD-518988.1 | 56.8 | 19.5 | 80.0 | 26.5 | 86.4 | 1.6 |
| AD-519305.1 | 79.5 | 11.9 | 105.5 | 20.8 | 95.4 | 20.1 |
| AD-519613.1 | 80.4 | 7.8 | 118.8 | 25.0 | 109.9 | 31.4 |
| AD-519121.1 | 73.3 | 11.7 | 105.3 | 15.4 | 92.5 | 20.7 |
| AD-519095.1 | 67.5 | 7.3 | 96.6 | 12.7 | 79.1 | 15.9 |
| AD-518982.1 | 84.1 | 11.8 | 102.3 | 17.9 | 85.5 | 14.6 |
| AD-519096.1 | 67.1 | 25.2 | 95.0 | 13.2 | 93.0 | 17.4 |
| AD-518986.1 | 66.1 | 20.6 | 89.7 | 15.6 | 87.7 | 12.2 |
| AD-518921.1 | 70.9 | 10.9 | 106.0 | 15.7 | 93.2 | 13.3 |
| AD-518985.1 | 50.1 | 6.9 | 103.5 | 21.2 | 93.9 | 6.5 |
| AD-518984.1 | 63.4 | 9.0 | 100.8 | 12.9 | 88.6 | 14.2 |
| AD-519325.1 | 55.5 | 21.1 | 91.3 | 22.8 | 85.2 | 8.4 |
| AD-518812.1 | 73.5 | 10.8 | 97.7 | 16.5 | 92.5 | 10.4 |
| AD-518987.1 | 71.8 | 6.9 | 103.7 | 30.5 | 83.8 | 18.6 |
| AD-518958.1 | 90.6 | 14.1 | 101.6 | 19.1 | 89.7 | 17.2 |
| AD-67572.2 | 82.4 | 5.9 | 90.5 | 30.4 | 95.9 | 10.6 |
| AD-518980.1 | 92.4 | 19.0 | 91.3 | 6.0 | 91.2 | 9.6 |
| AD-519070.1 | 90.6 | 12.2 | 101.4 | 7.7 | 107.6 | 3.4 |
| AD-518925.1 | 77.4 | 19.4 | 89.6 | 16.7 | 100.6 | 27.1 |
| AD-518981.1 | 92.4 | 27.7 | 108.2 | 18.0 | 100.8 | 33.9 |

TABLE 17

PNPLA3 Single Dose Screen in Hep3B Cells

| DuplexID | 10 nM % of Message Remaining | ST DEV | 1 nM % of Message Remaining | ST DEV | 0.1 nM % of Message Remaining | ST DEV |
|---|---|---|---|---|---|---|
| AD-520062.3 | 11.5 | 7.8 | 18.8 | 6.0 | 63.8 | 7.2 |
| AD-520060.1 | 28.7 | 5.6 | 67.5 | 17.5 | 111.0 | 20.0 |
| AD-520064.3 | 30.1 | 2.8 | 56.9 | 4.9 | 94.7 | 10.2 |
| AD-518983.1 | 31.3 | 1.8 | 84.7 | 24.7 | 141.6 | 11.1 |
| AD-520061.1 | 32.3 | 6.2 | 56.8 | 5.2 | 101.0 | 25.0 |
| AD-520063.2 | 36.5 | 4.6 | 61.7 | 5.2 | 96.5 | 11.3 |
| AD-519615.1 | 38.6 | 4.7 | 36.2 | 9.9 | 91.7 | 15.5 |
| AD-519757.1 | 38.8 | 11.4 | 54.6 | 9.7 | 102.5 | 18.5 |
| AD-519329.1 | 39.7 | 11.3 | 71.7 | 3.6 | 87.5 | 13.4 |
| AD-519324.1 | 42.2 | 6.4 | 72.6 | 10.5 | 83.0 | 10.2 |
| AD-518811.1 | 43.4 | 7.6 | 66.6 | 17.1 | 108.4 | 17.2 |
| AD-520059.1 | 43.6 | 7.1 | 62.7 | 7.0 | 106.7 | 19.5 |
| AD-519616.1 | 44.9 | 6.7 | 71.7 | 9.8 | 91.4 | 12.4 |
| AD-518655.1 | 45.0 | 6.6 | 59.5 | 15.3 | 99.2 | 6.1 |
| AD-519617.1 | 48.2 | 2.5 | 60.5 | 11.5 | 74.6 | 5.8 |
| AD-519307.1 | 51 | 7.438 | 42.9 | 9.151 | 61.2 | 4.0 |
| AD-520065.3 | 51.0 | 8.8 | 63.3 | 7.1 | 101.9 | 22.0 |
| AD-519323.1 | 51.3 | 6.0 | 63.3 | 8.5 | 118.9 | 13.4 |
| AD-519331.1 | 51.3 | 4.8 | 82.6 | 19.5 | 97.3 | 20.7 |
| AD-518922.1 | 52.0 | 8.7 | 52.9 | 16.8 | 89.6 | 28.3 |
| AD-519339.1 | 52.1 | 5.5 | 61.7 | 9.2 | 99.9 | 21.0 |
| AD-67552.2 | 53.3 | 11.6 | 90.5 | 17.4 | 96.3 | 18.7 |
| AD-519756.1 | 53.5 | 8.4 | 55.4 | 1.9 | 91.2 | 7.1 |
| AD-519333.1 | 53.8 | 14.5 | 56.0 | 6.7 | 86.1 | 18.9 |
| AD-519612.1 | 54.1 | 9.3 | 77.7 | 6.6 | 119.4 | 10.3 |
| AD-519762.1 | 55.1 | 17.0 | 58.5 | 7.2 | 81.7 | 9.4 |
| AD-75265.3 | 55.2 | 6.6 | 74.8 | 9.0 | 118.0 | 11.8 |
| AD-67554.5 | 55.7 | 5.4 | 73.8 | 15.8 | 82.6 | 9.0 |
| AD-518928.1 | 56.0 | 1.7 | 55.7 | 9.6 | 82.7 | 15.6 |
| AD-519578.1 | 56.7 | 8.7 | 83.8 | 13.0 | 83.0 | 15.2 |
| AD-75277.3 | 56.8 | 6.7 | 65.3 | 12.8 | 78.6 | 13.0 |
| AD-519317.1 | 57.3 | 3.3 | 66.5 | 4.9 | 77.3 | 5.7 |
| AD-67581.5 | 57.8 | 6.6 | 74.1 | 7.4 | 84.7 | 5.9 |
| AD-519753.1 | 59.7 | 14.9 | 71.5 | 9.4 | 70.5 | 14.5 |
| AD-518701.1 | 59.9 | 8.4 | 60.6 | 8.0 | 78.9 | 9.4 |
| AD-519752.1 | 61.8 | 5.8 | 69.1 | 7.6 | 88.4 | 10.2 |
| AD-519328.1 | 61.9 | 10.8 | 54.9 | 5.2 | 101.1 | 18.4 |
| AD-519322.1 | 61.9 | 6.3 | 87.3 | 13.4 | 89.7 | 8.9 |

TABLE 17-continued

PNPLA3 Single Dose Screen in Hep3B Cells

| DuplexID | 10 nM % of Message Remaining | ST DEV | 1 nM % of Message Remaining | ST DEV | 0.1 nM % of Message Remaining | ST DEV |
|---|---|---|---|---|---|---|
| AD-519911.1 | 62.0 | 7.5 | 60.5 | 5.4 | 85.0 | 12.5 |
| AD-519029.1 | 62.7 | 9.1 | 73.1 | 13.7 | 99.6 | 23.7 |
| AD-519913.1 | 62.8 | 8.6 | 82.9 | 6.8 | 115.9 | 12.9 |
| AD-518924.1 | 63.1 | 11.6 | 82.5 | 10.4 | 98.7 | 19.6 |
| AD-519766.1 | 63.9 | 10.0 | 91.6 | 24.3 | 117.8 | 22.0 |
| AD-519069.1 | 64.0 | 4.0 | 83.2 | 15.3 | 104.9 | 13.2 |
| AD-519614.1 | 64.3 | 5.4 | 36.1 | 5.3 | 102.2 | 12.9 |
| AD-519618.1 | 64.5 | 8.4 | 66.4 | 4.1 | 98.7 | 15.3 |
| AD-519326.1 | 64.9 | 24.3 | 91.7 | 19.4 | 113.9 | 29.3 |
| AD-518920.1 | 65.2 | 12.2 | 72.0 | 2.5 | 108.1 | 18.7 |
| AD-519760.1 | 66.7 | 10.6 | 55.6 | 14.0 | 101.3 | 28.9 |
| AD-518813.1 | 66.7 | 3.9 | 69.7 | 13.9 | 95.0 | 13.2 |
| AD-519396.1 | 67.6 | 11.9 | 72.2 | 15.4 | 96.3 | 20.3 |
| AD-519935.1 | 67.8 | 11.0 | 54.2 | 16.1 | 94.7 | 19.6 |
| AD-519758.1 | 67.8 | 8.7 | 82.6 | 6.1 | 100.4 | 12.5 |
| AD-518831.1 | 68.3 | 7.5 | 61.1 | 7.6 | 117.6 | 18.9 |
| AD-518923.1 | 68.5 | 18.3 | 49.8 | 8.3 | 65.8 | 5.4 |
| AD-519755.2 | 69.6 | 9.3 | 66.7 | 13.7 | 80.9 | 18.8 |
| AD-520116.1 | 69.8 | 8.6 | 72.4 | 10.5 | 93.5 | 10.7 |
| AD-519093.1 | 70.0 | 3.2 | 72.8 | 15.5 | 101.0 | 20.0 |
| AD-67588.2 | 70.3 | 16.6 | 77.1 | 16.7 | 81.0 | 15.7 |
| AD-519754.3 | 70.3 | 3.1 | 81.2 | 10.4 | 84.1 | 5.0 |
| AD-519308.1 | 70.6 | 12.8 | 70.4 | 9.9 | 89.1 | 8.7 |
| AD-519759.1 | 72.7 | 12.9 | 81.1 | 4.6 | 90.0 | 9.8 |
| AD-519763.1 | 73.4 | 15.7 | 90.9 | 13.9 | 109.1 | 30.5 |
| AD-519327.1 | 73.5 | 8.9 | 97.8 | 14.4 | 117.2 | 17.9 |
| AD-519761.1 | 73.7 | 7.4 | 64.9 | 7.0 | 119.2 | 16.2 |
| AD-518702.1 | 75.3 | 17.3 | 59.4 | 6.9 | 81.0 | 3.4 |
| AD-519094.1 | 76.3 | 8.0 | 88.9 | 15.9 | 91.4 | 4.9 |
| AD-518832.1 | 80.2 | 5.7 | 97.1 | 11.2 | 104.6 | 20.7 |
| AD-519767.1 | 82.0 | 10.1 | 92.9 | 14.7 | 106.7 | 17.6 |
| AD-518917.1 | 82.5 | 8.7 | 83.9 | 11.7 | 115.4 | 35.5 |
| AD-518988.1 | 82.7 | 7.5 | 98.1 | 25.0 | 99.7 | 24.8 |
| AD-519305.1 | 83.4 | 11.1 | 85.6 | 9.8 | 85.2 | 17.2 |
| AD-519613.1 | 84.6 | 10.0 | 101.9 | 14.8 | 91.5 | 6.8 |
| AD-519121.1 | 84.7 | 17.85 | 76.2 | 12.1 | 93.5 | 11.1 |
| AD-519095.1 | 86.7 | 51.2 | 93.7 | 13.9 | 102.9 | 8.5 |
| AD-518982.1 | 88.3 | 8.4 | 111.5 | 20.0 | 136.3 | 25.7 |
| AD-519096.1 | 89.1 | 20.1 | 94.4 | 8.7 | 89.4 | 13.4 |
| AD-518986.1 | 89.8 | 7.6 | 105.3 | 10.8 | 108.6 | 20.8 |
| AD-518921.1 | 94.8 | 6.1 | 102.5 | 17.6 | 117.3 | 20.5 |
| AD-518985.1 | 95.3 | 18.0 | 91.6 | 19.9 | 133.4 | 23.9 |
| AD-518984.1 | 95.7 | 10.9 | 108.4 | 17.5 | 98.6 | 31.2 |
| AD-519325.1 | 95.7 | 13.3 | 103.4 | 20.2 | 138.5 | 12.3 |
| AD-518812.1 | 96.3 | 9.5 | 90.9 | 19.8 | 129.1 | 18.0 |
| AD-518987.1 | 99.8 | 15.1 | 94.2 | 19.4 | 87.6 | 22.5 |
| AD-518958.1 | 102.9 | 15.9 | 107.4 | 17.9 | 93.7 | 7.0 |
| AD-67572.2 | 109.7 | 17.8 | 112.8 | 14.9 | 133.8 | 13.3 |
| AD-518980.1 | 111.5 | 3.6 | 114.5 | 17.5 | 106.7 | 18.4 |
| AD-519070.1 | 114.9 | 19.2 | 104.6 | 12.7 | 112.8 | 11.8 |
| AD-518925.1 | 117.1 | 9.9 | 118.4 | 16.0 | 80.3 | 5.4 |
| AD-518981.1 | 127.7 | 11.0 | 109.6 | 23.6 | 96.1 | 11.5 |

TABLE 18

PNPLA3 Single Dose Screen in Cos-7 Cells (Human Dual-Luciferase psiCHECK2 vector)

| DuplexID | 50 nM % of Message Remaining | ST DEV | 10 nM % of Message Remaining | ST DEV | 1 nM % of Message Remaining | ST DEV | 0.1 nM % of Message Remaining | ST DEV |
|---|---|---|---|---|---|---|---|---|
| AD-521086.1 | 19.5 | 7.9 | | | | | | |
| AD-805632.1 | | | 78.2 | 9.4 | 86.1 | 14.1 | 82.9 | 13.9 |
| AD-805644.1 | | | 94.2 | 12.3 | 98.0 | 15.8 | 93.5 | 24.2 |
| AD-521465.1 | 19.2 | 10.1 | | | | | | |
| AD-805631.1 | | | 32.8 | 8.2 | 69.8 | 16.2 | 103.4 | 3.9 |
| AD-805643.1 | | | 67.1 | 13.2 | 95.1 | 18.0 | 91.9 | 15.7 |
| AD-520902.1 | 24.1 | 9.4 | | | | | | |
| AD-805634.1 | | | 61.6 | 5.2 | 91.7 | 13.2 | 101.0 | 13.3 |
| AD-805646.1 | | | 76.3 | 15.6 | 77.5 | 18.6 | 78.0 | 12.5 |
| AD-522140.1 | 24.3 | 4.9 | | | | | | |
| AD-805635.1 | | | 31.1 | 11.5 | 56.5 | 7.6 | 74.8 | 12.2 |
| AD-805647.1 | | | 77.9 | 6.4 | 88.6 | 15.9 | 98.2 | 15.2 |
| AD-520903.1 | 17.6 | 14.3 | | | | | | |
| AD-805628.1 | | | 90.5 | 13.5 | 89.6 | 22.6 | 95.7 | 8.1 |
| AD-805640.1 | | | 98.8 | 19.0 | 102.0 | 8.7 | 92.8 | 8.1 |
| AD-520973.1 | 13.0 | 9.6 | | | | | | |
| AD-805625.1 | | | 98.8 | 16.3 | 99.8 | 13.9 | 90.4 | 6.5 |
| AD-805637.1 | | | 109.0 | 27.2 | 90.5 | 7.5 | 104.5 | 21.2 |
| AD-521129.1 | 18.9 | 5.7 | | | | | | |
| AD-805630.1 | | | 67.5 | 18.8 | 121.7 | 33.2 | 104.0 | 19.0 |
| AD-805642.1 | | | 66.1 | 8.1 | 94.9 | 21.9 | 92.2 | 19.3 |
| AD-521124.1 | 15.6 | 12.7 | | | | | | |
| AD-805626.1 | | | 50.3 | 18.2 | 88.4 | 10.9 | 96.6 | 15.9 |
| AD-805638.1 | | | 84.8 | 16.6 | 86.4 | 7.5 | 93.1 | 5.4 |
| AD-521420.1 | 12.6 | 5.2 | | | | | | |
| AD-805624.1 | | | 23.0 | 8.7 | 32.9 | 3.5 | 86.6 | 17.4 |
| AD-805636.1 | | | 58.4 | 11.6 | 91.3 | 18.9 | 95.1 | 17.6 |
| AD-521840.1 | 17.8 | 3.3 | | | | | | |
| AD-805629.1 | | | 48.7 | 16.6 | 78.6 | 15.6 | 121.6 | 21.4 |
| AD-805641.1 | | | 89.0 | 12.5 | 97.2 | 22.4 | 96.1 | 14.5 |
| AD-521409.1 | 20.5 | 12.1 | | | | | | |

TABLE 18-continued

PNPLA3 Single Dose Screen in Cos-7 Cells (Human Dual-Luciferase psiCHECK2 vector)

| DuplexID | 50 nM % of Message Remaining | 50 nM ST DEV | 10 nM % of Message Remaining | 10 nM ST DEV | 1 nM % of Message Remaining | 1 nM ST DEV | 0.1 nM % of Message Remaining | 0.1 nM ST DEV |
|---|---|---|---|---|---|---|---|---|
| AD-805633.1 | | | 83.0 | 15.2 | 98.6 | 20.5 | 91.8 | 13.6 |
| AD-805645.1 | | | 53.2 | 7.4 | 80.7 | 6.3 | 104.6 | 15.8 |
| AD-521486.1 | 17.6 | 4.6 | | | | | | |
| AD-805627.1 | | | 61.1 | 7.9 | 100.3 | 17.8 | 83.7 | 17.9 |
| AD-805639.1 | | | 89.7 | 8.6 | 101.3 | 18.2 | 85.1 | 10.0 |

TABLE 19

PNPLA3 Single Dose Screen in Hep3B Cells

| DuplexID | 10 nM % of Message Remaining | 10 nM ST DEV | 1 nM % of Message Remaining | 1 nM ST DEV | 0.1 nM % of Message Remaining | 0.1 nM ST DEV |
|---|---|---|---|---|---|---|
| AD-521086.1 | | | | | | |
| AD-805632.1 | 58.2 | 6.1 | 65.1 | 10.6 | 91.6 | 17.9 |
| AD-805644.1 | 90.5 | 19.6 | 101.7 | 9.9 | 91.9 | 14.7 |
| AD-521465.1 | | | | | | |
| AD-805631.1 | 54.6 | 4.6 | 81.2 | 9.9 | 102.5 | 13.4 |
| AD-805643.1 | 64.0 | 11.6 | 80.5 | 23.2 | 92.2 | 8.3 |
| AD-520902.1 | | | | | | |
| AD-805634.1 | 102.2 | 18.8 | 88.4 | 4.6 | 113.2 | 20.7 |
| AD-805646.1 | 95.8 | 12.0 | 95.3 | 5.6 | 81.5 | 8.5 |
| AD-522140.1 | | | | | | |
| AD-805635.1 | 90.2 | 10.5 | 52.8 | 6.7 | 84.9 | 14.4 |
| AD-805647.1 | 96.5 | 24.1 | 73.6 | 4.3 | 83.4 | 11.4 |
| AD-520903.1 | | | | | | |
| AD-805628.1 | 105.2 | 25.9 | 106.7 | 6.8 | 101.7 | 16.1 |
| AD-805640.1 | 103.1 | 6.2 | 97.8 | 13.0 | 91.9 | 9.5 |
| AD-520973.1 | | | | | | |
| AD-805625.1 | 109.4 | 11.7 | 112.1 | 21.2 | 109.8 | 21.6 |
| AD-805637.1 | 123.9 | 17.4 | 112.6 | 13.6 | 108.7 | 15.7 |
| AD-521129.1 | | | | | | |
| AD-805630.1 | 105.9 | 6.0 | 109.6 | 13.9 | 121.5 | 16.2 |
| AD-805642.1 | 109.0 | 19.2 | 91.3 | 11.0 | 110.5 | 13.3 |
| AD-521124.1 | | | | | | |
| AD-805626.1 | 74.6 | 8.2 | 87.8 | 10.7 | 112.2 | 10.1 |
| AD-805638.1 | 98.0 | 9.2 | 97.9 | 6.4 | 104.3 | 13.6 |
| AD-521420.1 | | | | | | |
| AD-805624.1 | 33.7 | 5.4 | 42.4 | 9.2 | 53.2 | 6.9 |
| AD-805636.1 | 82.1 | 7.5 | 89.7 | 8.8 | 95.7 | 11.6 |
| AD-521840.1 | | | | | | |
| AD-805629.1 | 60.7 | 5.7 | 82.3 | 17.7 | 93.5 | 5.7 |
| AD-805641.1 | 122.2 | 21.4 | 115.9 | 21.0 | 111.4 | 9.3 |
| AD-521409.1 | | | | | | |
| AD-805633.1 | 116.6 | 19.7 | 107.0 | 24.0 | 127.8 | 17.3 |
| AD-805645.1 | 96.6 | 9.7 | 89.0 | 11.0 | 90.9 | 13.2 |
| AD-521486.1 | | | | | | |
| AD-805627.1 | 56.3 | 6.9 | 78.2 | 14.1 | 115.9 | 10.4 |
| AD-805639.1 | 117.8 | 13.8 | 112.2 | 9.7 | 94.7 | 9.5 |

Example 3. In Vivo Screening of dsRNA Duplexes in Mice

Duplexes of interest, identified from the above in vitro studies, were evaluated in vivo. In particular, at pre-dose day −14 wild-type mice (C57BL/6) were transduced by intravenous administration of $2 \times 10^{11}$ viral particles of an adeno-associated virus 8 (AAV8) vector encoding human PNPLA3. In particular, mice were administered an AAV8 encoding the open reading frame and 3' UTR of human PNPLA3 mRNA referenced as NM_025225.2 (AAV8.-TBG-PI-PNPLA3).

At day 0, groups of three mice were subcutaneously administered a single 3 mg/kg dose or a single 10 mg/kg of the agents of interest or PBS control. Table 20 provides the treatment groups and Table 21 provides the modified nucleotide sequences of the sense and antisense strands of the duplexes of interest. At day 7 or day 14 post-dose animals were sacrificed, liver samples were collected and snap-frozen in liquid nitrogen. Tissue mRNA was extracted and analyzed by the RT-QPCR method.

Human PNPLA3 mRNA levels were compared to housekeeping gene GAPDH. The values were then normalized to the average of PBS vehicle control group. The data were expressed as percent of baseline value, and presented as mean plus standard deviation. The results, listed in Table 22 and shown in FIG. 1, demonstrate that the exemplary duplex agents tested effectively reduce the level of the human PNPLA3 messenger RNA in vivo.

TABLE 20

| Group # | Animal # | Treatment | Dose | Timepoint (Day) |
|---|---|---|---|---|
| 1 | 1 | PBS | n/a | D7 |
| | 2 | | | |
| | 3 | | | |
| 2 | 4 | Naïve | n/a | |
| | 5 | | | |
| | 6 | | | |
| 3 | 7 | AD-517197.2 | 3 mpk | |
| | 8 | | | |
| | 9 | | | |
| 4 | 10 | AD-517258.2 | | |
| | 11 | | | |
| | 12 | | | |
| 5 | 13 | AD-517197.2 | 10 mpk | |
| | 14 | | | |
| | 15 | | | |
| 6 | 16 | AD-517258.2 | | |
| | 17 | | | |
| | 18 | | | |
| 7 | 19 | PBS | n/a | D14 |
| | 20 | | | |
| | 21 | | | |
| 8 | 22 | Naïve | n/a | |
| | 23 | | | |
| | 24 | | | |
| 9 | 25 | AD-517197.2 | 3 mpk | |
| | 26 | | | |
| | 27 | | | |
| 10 | 28 | AD-517258.2 | | |
| | 29 | | | |
| | 30 | | | | agents tested effectively reduce the level of the human PNPLA3 messenger RNA in vivo.

TABLE 20-continued

| Group # | Animal # | Treatment | Dose | Timepoint (Day) |
|---|---|---|---|---|
| 11 | 31 | AD-517197.2 | 10 mpk | |
| | 32 | | | |
| | 33 | | | |
| 12 | 34 | AD-517258.2 | | |
| | 35 | | | |
| | 36 | | | |

TABLE 21

| Duplex ID | Oligo ID | Strand | Nucleotide Sequence 5' to 3' | SEQ ID NO: |
|---|---|---|---|---|
| AD-517197.2 | A-150304.3 | sense | csasugagCfaAfGfAfuuugcaacuuL96 | 1746 |
| | A-999710.1 | antis | asAfsguug(Cgn)aaaucuUfgCfucaugsusa | 1747 |
| AD-517258.2 | A-999829.1 | sense | ascsuugcUfaCfCfCfauuaggauauL96 | 1748 |
| | A-999830.1 | antis | asUfsaucc(Tgn)aaugggUfaGfcaagsusg | 1749 |

TABLE 22

| Duplex | % Message Remaining Normalized to PBS | SD |
|---|---|---|
| PBS Day 7 | 101.19 | 11.20 |
| Naïve Day 7 | 89.04 | 18.18 |
| AD-517197.2 3 mpk | 84.36 | 5.65 |
| AD-517258 3 mpk | 76.75 | 12.42 |
| AD-517197.2 10 mpk | 56.72 | 6.90 |
| AD-517258 10 mpk | 77.23 | 10.55 |
| PBS Day 14 | 103.60 | 19.54 |
| Naïve Day 14 | 95.55 | 14.11 |
| AD-517197.2 3 mpk | 89.05 | 3.84 |
| AD-517258 3 mpk | 136.33 | 11.85 |
| AD-517197.2 10 mpk | 78.79 | 9.48 |
| AD-517258 10 mpk | 61.83 | 6.29 |

Additional duplexes of interest, identified from the above in vitro studies, were also evaluated in vivo. In particular, at pre-dose day −14 wild-type mice (C57BL/6) were transduced by intravenous administration of 2×10¹¹ viral particles of an adeno-associated virus 8 (AAV8) vector encoding human PNPLA3. In particular, mice were administered an AAV8 encoding the open reading frame and the 3' UTR of human PNPLA3 referenced in NM_025225.2 (AAV8.-TBG-PI-PNPLA3).

At day 0, time 0, groups of three mice were subcutaneously administered a single 3 mg/kg dose of an agent of interest (with the exception of AD-517258.2) which was followed about 1 hour later by a single 7 mg/kg dose of the same agent administered at time 0, or PBS control at day 0, time 0. Mice administered AD-517258.2 were only administered a single 3 mg/kg dose at day 0, time 0. Table 20 provides the treatment groups and Table 21 provides the modified nucleotide sequences of the sense and antisense strands of the duplexes of interest. At day 7 post-dose animals were sacrificed, liver samples were collected and snap-frozen in liquid nitrogen. Tissue mRNA was extracted and analyzed by the RT-QPCR method.

Figure 2:
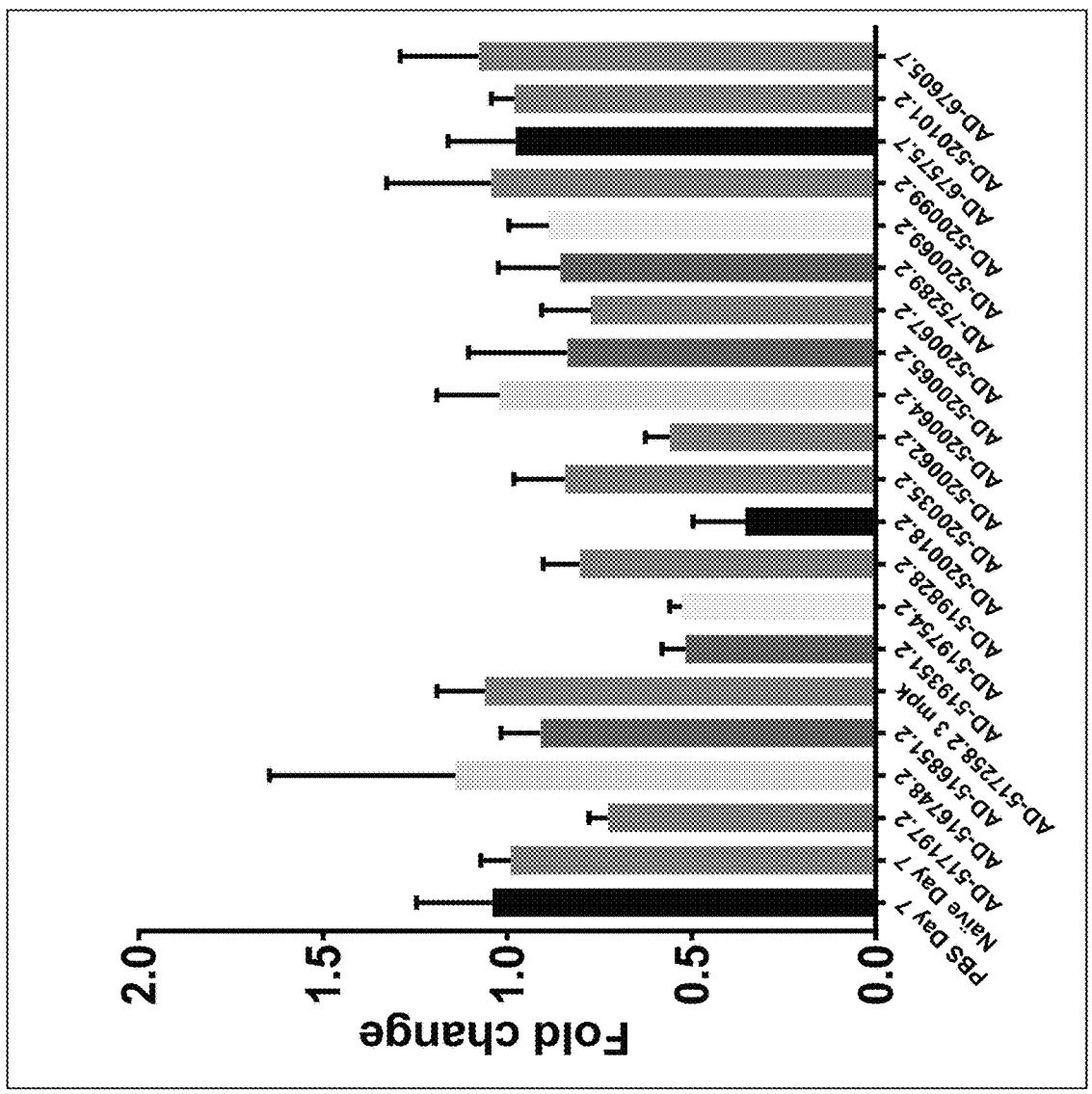
FIG. 2 is a graph showing human PNPLA3 mRNA levels in mice (n=3 per group) subcutaneously administered a single dose of the indicated dsRNA duplexes, on day 7 post-dose as described in Example 3. Human PNPLA3 mRNA levels are shown relative to control levels detected with PBS treatment.

Human PNPLA3 mRNA levels were compared to housekeeping gene GAPDH. The values were then normalized to the average of PBS vehicle control group. The data were expressed as percent of baseline value, and presented as mean plus standard deviation. The results, listed in Table 25 and shown in FIG. 2, demonstrate that the exemplary duplex

TABLE 23

| Group # | Animal # | Treatment | Dose |
|---|---|---|---|
| 1 | 1 | PBS | n/a |
| | 2 | | |
| | 3 | | |
| 2 | 4 | Naïve | n/a |
| | 5 | | |
| | 6 | | |
| 3 | 7 | AD-517197.2 | 10 mpk (3 mpk followed by 7 mpk ~1 hr later) |
| | 8 | | |
| | 9 | | |
| 4 | 10 | AD-516748.2 | |
| | 11 | | |
| | 12 | | |
| 5 | 13 | AD-516851.2 | |
| | 14 | | |
| | 15 | | |
| 6 | 16 | AD-517258.2 | 3 mpk |
| | 17 | | |
| | 18 | | |
| 7 | 19 | AD-519351.2 | 10 mpk (3 mpk followed by 7 mpk ~1 hr later) |
| | 20 | | |
| | 21 | | |
| 8 | 22 | AD-519754.2 | |
| | 23 | | |
| | 24 | | |
| 9 | 25 | AD-519828.2 | |
| | 26 | | |
| | 27 | | |
| 10 | 28 | AD-520018.2 | |
| | 29 | | |
| | 30 | | |
| 11 | 31 | AD-520035.2 | |
| | 32 | | |
| | 33 | | |
| 12 | 34 | AD-520062.2 | |
| | 35 | | |
| | 36 | | |
| 13 | 37 | AD-520064.2 | |
| | 38 | | |
| | 39 | | |
| 14 | 40 | AD-520065.2 | |
| | 41 | | |
| | 42 | | |
| 15 | 43 | AD-520067.2 | |
| | 44 | | |
| | 45 | | |
| 16 | 46 | AD-75289.2 | |
| | 47 | | |
| | 48 | | |
| 17 | 49 | AD-520069.2 | |
| | 50 | | |
| | 51 | | |

TABLE 23-continued

| Group # | Animal # | Treatment | Dose |
|---|---|---|---|
| 18 | 52 | AD-520099.2 | |
| | 53 | | |
| | 54 | | |
| 19 | 55 | AD-67575.7 | |
| | 56 | | |
| | 57 | | |

TABLE 23-continued

| Group # | Animal # | Treatment | Dose |
|---|---|---|---|
| 20 | 58 | AD-520101.2 | 5 |
| | 59 | | |
| | 60 | | |
| 21 | 61 | AD-67605.7 | |
| | 62 | | |
| | 63 | | |

TABLE 24

| Duplex ID | Oligo ID | Strand | SEQ ID NO: | Nucleotide Sequence 5' to 3' |
|---|---|---|---|---|
| AD-517197.2 | A-150304.3 | sense | 1750 | csasugagCfaAfGfAfuuugcaacuuL96 |
| | A-999710.1 | antis | 1751 | asAfsguug(Cgn)aaaucuUfgCfucaugsusa |
| AD-516748.2 | A-998818.1 | sense | 1752 | asasagacGfaAfGfUfcguggaugcuL96 |
| | A-998819.1 | antis | 1753 | asGfscauc(Cgn)acgacuUfcGfucuuusgsg |
| AD-516851.2 | A-999023.1 | sense | 1754 | usgsaugcCfaAfAfAfcaaccaucauL96 |
| | A-999024.1 | antis | 1755 | asUfsgaug(Ggn)uuguuuUfgGfcaucasasu |
| AD-517258.2 | A-999829.1 | sense | 1756 | ascsuugcUfaCfCfCfauuaggauauL96 |
| | A-999830.1 | antis | 1757 | asUfsaucc(Tgn)aaugggUfaGfcaagususg |
| AD-519351.2 | A-999855.1 | sense | 1758 | asgsgauaAfuGfUfCfuuuauguaauuL96 |
| | A-1003070.1 | antis | 1759 | asAfsuuaCfaUfAfagacAfuUfauccusasa |
| AD-519754.2 | A-1000664.1 | sense | 1760 | gsasgcugAfgUfUfGfguuuuaugauL96 |
| | A-1003473.1 | antis | 1761 | asUfscauAfaAfAfccaaCfuCfagcucsasg |
| AD-519828.2 | A-1000812.1 | sense | 1762 | csasucagCfaUfGfCfguuaauucauL96 |
| | A-1003547.1 | antis | 1763 | asUfsgaaUfuAfAfcgcaUfgCfugaugsusa |
| AD-520018.2 | A-1001193.1 | sense | 1764 | gsasuaacCfuUfGfAfcuacuaaaauL96 |
| | A-1003737.1 | antis | 1765 | asUfsuuuAfgUfAfgucaAfgGfuuaucsasu |
| AD-520035.2 | A-1001228.1 | sense | 1766 | gsgsuaacAfaGfAfUfgauaaucuauL96 |
| | A-1003754.1 | antis | 1767 | asUfsagaUfuAfUfcaucUfuGfuuaccscsc |
| AD-520062.2 | A-1001282.1 | sense | 1768 | ascscuuuUfuCfAfCfcuaacuaaauL96 |
| | A-1003781.1 | antis | 1769 | asUfsuuaGfuUfAfggugAfaAfaaggusgsu |
| AD-520064.2 | A-1001286.1 | sense | 1770 | csusuuuuCfaCfCfUfaacuaaaauuL96 |
| | A-1003783.1 | antis | 1771 | asAfsuuuUfaGfUfuaggUfgAfaaaagsgsu |
| AD-520065.2 | A-1001288.1 | sense | 1772 | ususuuuCfaCfCfUfAfacuaaaauauL96 |
| | A-1003784.1 | antis | 1773 | asUfsauuUfuAfGfuuagGfuGfaaaaasgsg |
| AD-520067.2 | A-1001292.1 | sense | 1774 | ususucacCfuAfAfCfuaaaauaauuL96 |
| | A-1003786.1 | antis | 1775 | asAfsuuaUfuUfUfaguuAfgGfugaaasasa |
| AD-75289.2 | A-150350.2 | sense | 1776 | ususcaccUfaAfCfUfaaaauaauguL96 |
| | A-150351.2 | antis | 1777 | asCfsauuAfuUfUfaguUfaGfgugaasasa |
| AD-520069.2 | A-1001296.1 | sense | 1778 | csasccuaAfcUfAfAfaauaauguuuL96 |
| | A-1003788.1 | antis | 1779 | asAfsacaUfuAfUfuuuaGfuUfaggugsasa |
| AD-520099.2 | A-1001362.1 | sense | 1780 | usgsuuacCfuGfUfUfgaauuuguuL96 |
| | A-1003818.1 | antis | 1781 | asAfscaaAfaUfUfcaacAfgGfuaacasasc |

TABLE 24-continued

| Duplex ID | Oligo ID | Strand | SEQ ID NO: | Nucleotide Sequence 5' to 3' |
|---|---|---|---|---|
| AD-67575.7 | A-135333.4 | sense | 1782 | ususaccuGfuUfGfAfauuuuguauuL96 |
|  | A-135334.4 | antis | 1783 | asAfsuacAfaAfAfuucaAfcAfgguaascsa |
| AD-520101.2 | A-1001366.1 | sense | 1784 | usasccugUfuGfAfAfuuuuguauuuL96 |
|  | A-1003820.1 | antis | 1785 | asAfsauaCfaAfAfauucAfaCfagguasasc |
| AD-67605.7 | A-135397.4 | sense | 1786 | ascscuguUfgAfAfUfuuuguauuauL96 |
|  | A-135398.4 | antis | 1787 | asUfsaauAfcAfAfaauuCfaAfcaggusasa |

TABLE 25

| Duplex | % message remaining | SD |
|---|---|---|
| PBS | 103.93 | 20.88 |
| Naïve | 98.96 | 8.18 |
| AD-517197.2 | 72.73 | 5.25 |
| AD-516748.2 | 113.80 | 50.63 |
| AD-516851.2 | 90.77 | 10.59 |
| AD-517258.2 | 106.22 | 12.98 |
| AD-519351.2 | 51.51 | 6.40 |
| AD-519754.2 | 52.67 | 3.53 |
| AD-519828.2 | 80.26 | 9.81 |
| AD-520018.2 | 35.16 | 14.27 |
| AD-520035.2 | 84.43 | 13.85 |
| AD-520062.2 | 55.69 | 6.76 |
| AD-520064.2 | 101.98 | 17.12 |
| AD-520065.2 | 83.81 | 26.80 |
| AD-520067.2 | 77.07 | 13.29 |
| AD-75289.2 | 85.71 | 16.74 |
| AD-520069.2 | 88.70 | 10.81 |
| AD-520099.2 | 104.33 | 28.27 |
| AD-67575.7 | 97.80 | 18.17 |
| AD-520101.2 | 97.77 | 6.29 |
| AD-67605.7 | 107.86 | 21.32 |

Additional duplexes of interest, identified from the above in vitro studies, were also evaluated in vivo in an AAV titration study. In particular, at pre-dose day −14 wild-type mice (C57BL/6) were transduced by intravenous administration of $2\times10^{11}$, $2\times10^{10}$, $2\times10^{9}$, or $2\times10^{8}$ viral particles of an adeno-associated virus 8 (AAV8) vector encoding human PNPLA3. In particular, mice were administered an AAV8 encoding a portion of human PNPLA3 mRNA encoding the open reading frame and 3' UTR of human PNPLA3 mRNA referenced as NM_025225.2 (AAV8.-TBG-PI-PNPLA3).

At day 0, time 0, groups of three mice were subcutaneously administered a single 10 mg/kg dose of an agent of interest or PBS control. Table 26 provides the treatment groups and Table 27 provides the modified nucleotide sequences of the sense and antisense strands of the duplexes of interest. At day 7 post-dose animals were sacrificed, liver samples were collected and snap-frozen in liquid nitrogen. Tissue mRNA was extracted and analyzed by the RT-QPCR method.

Figure 3:
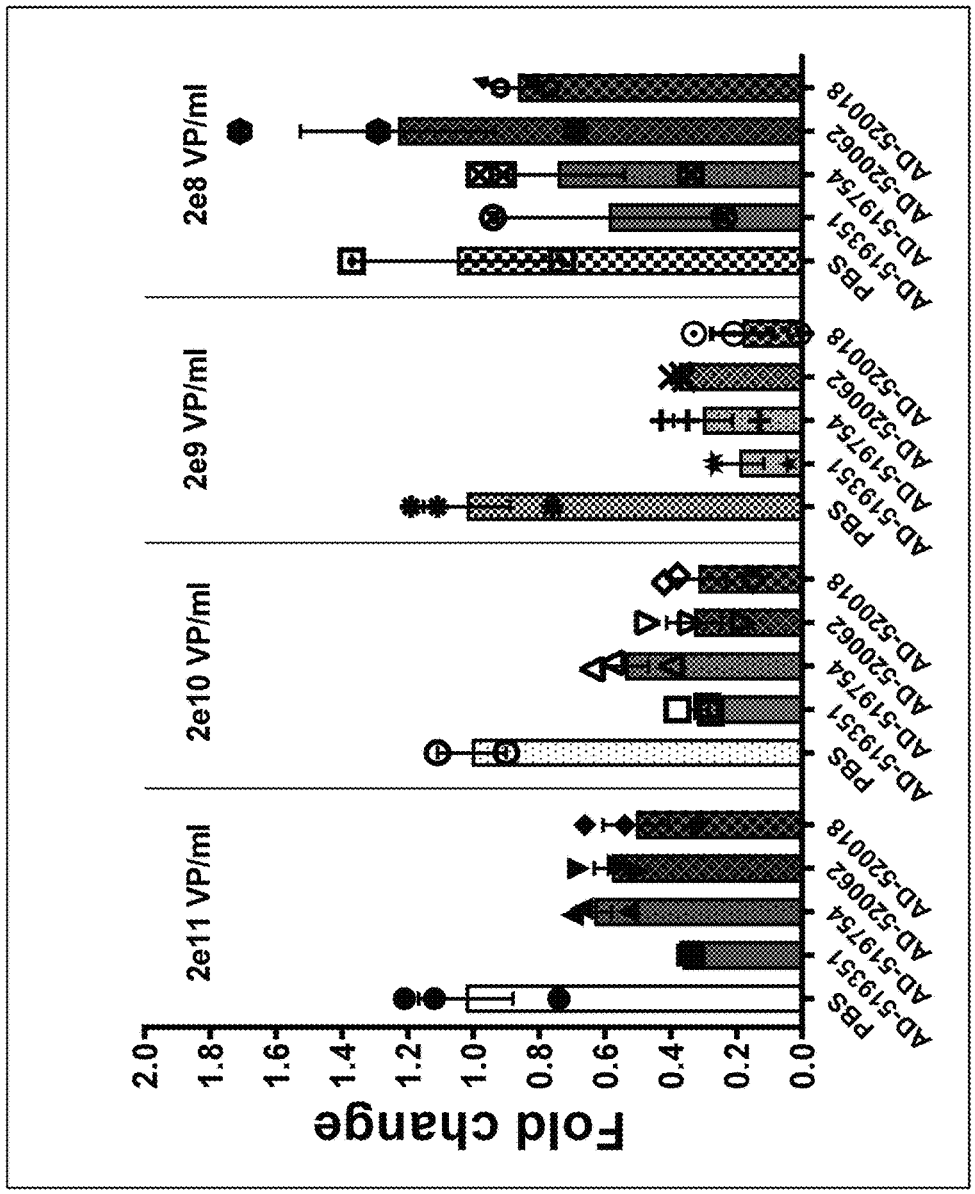
FIG. 3 is a graph showing human PNPLA3 mRNA levels in mice (n=3 per group) subcutaneously administered a single 10 mg/kg dose of the indicated dsRNA duplexes, on day 7 post-dose. Human PNPLA3 mRNA levels are shown relative to control levels detected with PBS treatment.

Human PNPLA3 mRNA levels were compared to housekeeping gene GAPDH. The values were then normalized to the average of PBS vehicle control group. The data were expressed as percent of baseline value, and presented as mean plus standard deviation. The results, listed in Table 28 and shown in FIG. 3, demonstrate that the exemplary duplex agents tested effectively reduce the level of the human PNPLA3 messenger RNA in vivo.

TABLE 26

| Group # | Animal # | Treatment | Dose | AAV Titer (vp/mouse) |
|---|---|---|---|---|
| 1 | 1 | PBS | n/a | 2.00E+11 |
|  | 2 |  |  |  |
|  | 3 |  |  |  |
| 2 | 4 | AD-519351.4 | 10 mpk |  |
|  | 5 |  |  |  |
|  | 6 |  |  |  |
| 3 | 7 | AD-519754.5 |  |  |
|  | 8 |  |  |  |
|  | 9 |  |  |  |
| 4 | 10 | AD-520062.5 |  |  |
|  | 11 |  |  |  |
|  | 12 |  |  |  |
| 5 | 13 | AD-520018.6 |  |  |
|  | 14 |  |  |  |
|  | 15 |  |  |  |
| 6 | 16 | PBS | n/a | 2.00E+10 |
|  | 17 |  |  |  |
|  | 18 |  |  |  |
| 7 | 19 | AD-519351.4 | 10 mpk |  |
|  | 20 |  |  |  |
|  | 21 |  |  |  |
| 8 | 22 | AD-519754.5 |  |  |
|  | 23 |  |  |  |
|  | 24 |  |  |  |
| 9 | 25 | AD-520062.5 |  |  |
|  | 26 |  |  |  |
|  | 27 |  |  |  |
| 10 | 28 | AD-520018.6 |  |  |
|  | 29 |  |  |  |
|  | 30 |  |  |  |
| 11 | 31 | PBS | n/a | 2.00E+09 |
|  | 32 |  |  |  |
|  | 33 |  |  |  |
| 12 | 34 | AD-519351.4 | 10 mpk |  |
|  | 35 |  |  |  |
|  | 36 |  |  |  |
| 13 | 37 | AD-519754.5 |  |  |
|  | 38 |  |  |  |
|  | 39 |  |  |  |
| 14 | 40 | AD-520062.5 |  |  |
|  | 41 |  |  |  |
|  | 42 |  |  |  |
| 15 | 43 | AD-520018.6 |  |  |
|  | 44 |  |  |  |
|  | 45 |  |  |  |
| 16 | 46 | PBS | n/a | 2.00E+08 |
|  | 47 |  |  |  |
|  | 48 |  |  |  |
| 17 | 49 | AD-519351.4 | 10 mpk |  |
|  | 50 |  |  |  |
|  | 51 |  |  |  |
| 18 | 52 | AD-519754.5 |  |  |
|  | 53 |  |  |  |
|  | 54 |  |  |  |

TABLE 26-continued

| Group # | Animal # | Treatment | Dose | AAV Titer (vp/mouse) |
|---|---|---|---|---|
| 19 | 55 | AD-520062.5 | | |
| | 56 | | | |
| | 57 | | | |
| 20 | 58 | AD-520018.6 | | |
| | 59 | | | |
| | 60 | | | |

TABLE 27

| Duplex ID | Oligo ID | Strand | Nucleotide Sequence 5' to 3' | SEQ ID NO: |
|---|---|---|---|---|
| AD-519351.4 | A-999855.2 | sense | asgsgauaAfuGfUfCfuuauguaaauuL96 | 1788 |
| | A-1003070.2 | antis | asAfsuuaCfaUfAfagacAfuUfauccusasa | 1789 |
| AD-519754.5 | A-1000664.3 | sense | gsasgcugAfgUfUfGfguuuuaugauL96 | 1790 |
| | A-1003473.3 | antis | asUfscauAfaAfAfccaaCfuCfagcucsasg | 1791 |
| AD-520062.5 | A-1001282.3 | sense | ascscuuuUfuCfAfCfcuaacuaaauL96 | 1792 |
| | A-1003781.3 | antis | asUfsuuaGfuUfAfggugAfaAfaaggusgsu | 1793 |
| AD-520018.6 | A-1001193.3 | sense | gsasuaacCfuUfGfAfcuacuaaaauL96 | 1794 |
| | A-1003737.3 | antis | asUfsuuuAfgUfAfgucaAfgGfuuaucsasu | 1795 |

TABLE 28

| AAV dose titer | Experimental treatment | Average Fold Change | SD |
|---|---|---|---|
| 2E11 | PBS | 1.02 | 0.25 |
| | AD-520018 | 0.34 | 0.01 |
| | AD-519351 | 0.63 | 0.09 |
| | AD-519754 | 0.58 | 0.09 |
| | AD-520062 | 0.51 | 0.17 |
| 2E10 | PBS | 1.09 | 0.49 |
| | AD-520018 | 0.37 | 0.07 |
| | AD-519351 | 0.64 | 0.15 |
| | AD-519754 | 0.39 | 0.17 |
| | AD-520062 | 0.37 | 0.18 |
| 2E9 | PBS | 1.02 | 0.23 |
| | AD-520018 | 0.19 | 0.13 |
| | AD-519351 | 0.30 | 0.16 |
| | AD-519754 | 0.38 | 0.02 |
| | AD-520062 | 0.18 | 0.16 |
| 2E8 | PBS | 1.05 | 0.45 |
| | AD-520018 | 0.59 | 0.50 |
| | AD-519351 | 0.74 | 0.35 |
| | AD-519754 | 1.23 | 0.52 |
| | AD-520062 | 0.87 | 0.10 |

Additional duplexes of interest, identified from the above in vitro studies, were also evaluated in vivo. In particular, at pre-dose day −14 wild-type mice (C57BL/6) were transduced by intravenous administration of $2\times10^{11}$ viral particles (corresponding to $2.4\times10^{13}$ genome copies/ml) of an adeno-associated virus 8 (AAV8) vector encoding human PNPLA3. In particular, mice were administered an AAV8 encoding a portion of human PNPLA3 mLRNA encoding the open reading frame and 3' UTR of human PNPLA3 mLRNA referenced as NM_025225.2 (AAV8.-TBG-PI-PNPLA3).

At day 0, one group of three mice for each agent of interest was subcutaneously administered a single 10 mg/kg dose of the agent of interest or PBS control. Another group of three mice for each agent of interest was subcutaneously administered a single 10 mg/kg dose of the agent of interest or PBS control at Day 0 and a subsequent 10 mg/kg dose of the agent at Day 1. A third group of three mice for each agent of interest was subcutaneously administered a single 10 mg/kg dose of the agent of interest or PBS control at Day 0, a subsequent 10 mg/kg dose of the agent at Day 1, and a further 10 mg/kg dose of the agent at Day 2. Table 29 provides the treatment groups and Table 30 provides the modified nucleotide sequences of the sense and antisense strands of the duplexes of interest. Seven days after the last dose was administered, animals were sacrificed, liver samples were collected and snap-frozen in liquid nitrogen. Tissue mRNA was extracted and analyzed by the RT-QPCR method.

Figure 4:
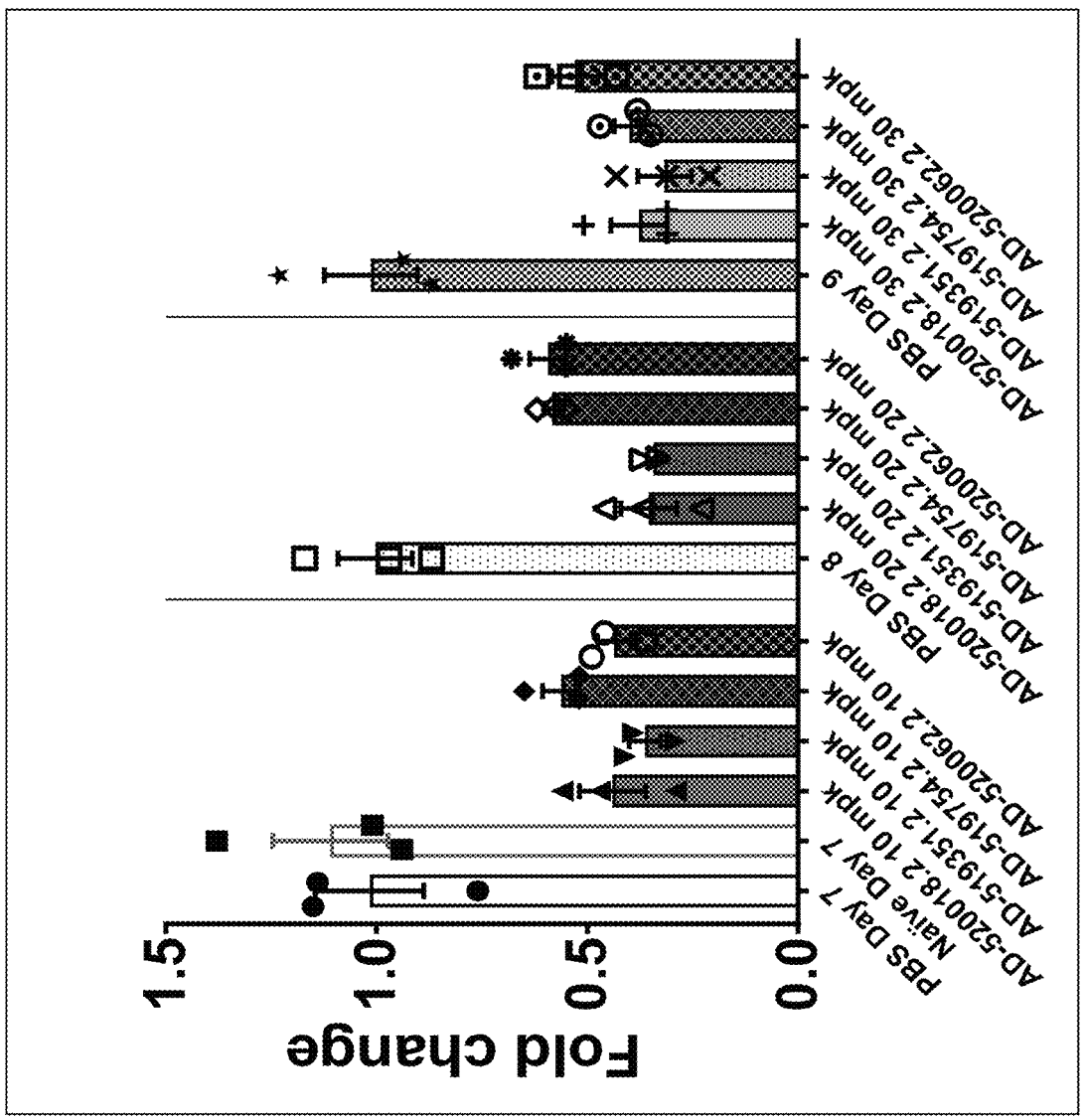
FIG. 4 is a graph showing human PNPLA3 mRNA levels in mice (n=3 per group) subcutaneously administered a single 10 mg/kg dose or multiple 10 mg/kg doses of the indicated dsRNA duplexes, on day 7 post-dose as described in Example 3. Human PNPLA3 mRNA levels are shown relative to control levels detected with PBS treatment.

Human PNPLA3 mRNA levels were compared to housekeeping gene GAPDH. The values were then normalized to the average of PBS vehicle control group. The data were expressed as percent of baseline value, and presented as mean plus standard deviation. The results, listed in Table 31 and shown in FIG. 4, demonstrate that the exemplary duplex agents tested effectively reduce the level of the human PNPLA3 messenger RNA in vivo.

TABLE 29

| Group # | Animal # | Treatment | Dose | End of Study |
|---|---|---|---|---|
| 1 | 1 | PBS | n/a | D7 |
| | 2 | | | |
| | 3 | | | |
| 2 | 4 | naïve | n/a | |
| | 5 | | | |
| | 6 | | | |
| 3 | 7 | AD-520018.2 | 10 mpk D0 | |
| | 8 | | | |
| | 9 | | | |
| 4 | 10 | AD-519351.2 | | |
| | 11 | | | |
| | 12 | | | |
| 5 | 13 | AD-519754.2 | | |
| | 14 | | | |
| | 15 | | | |
| 6 | 16 | AD-520062.2 | | |
| | 17 | | | |
| | 18 | | | |
| 7 | 19 | PBS | 10 mpk D0, 10 mpk D1 (20 mpk total) | D8 |
| | 20 | | | |
| | 21 | | | |
| 8 | 22 | AD-520018.2 | | |
| | 23 | | | |
| | 24 | | | |
| 9 | 25 | AD-519351.2 | | |
| | 26 | | | |
| | 27 | | | |
| 10 | 28 | AD-519754.2 | | |
| | 29 | | | |
| | 30 | | | |

TABLE 29-continued

| Group # | Animal # | Treatment | Dose | End of Study |
|---|---|---|---|---|
| 11 | 31 | AD-520062.2 | | |
|  | 32 | | | |
|  | 33 | | | |
| 12 | 34 | PBS | 10 mpk D0, | D9 |
|  | 35 | | 10 mpk D1, | |
|  | 36 | | 10 mpk D2 | |
| 13 | 37 | AD-520018.2 | (30 mpk total) | |
|  | 38 | | | |
|  | 39 | | | |
| 14 | 40 | AD-519351.2 | | |
|  | 41 | | | |
|  | 42 | | | |
| 15 | 43 | AD-519754.2 | | |
|  | 44 | | | |
|  | 45 | | | |
| 16 | 46 | AD-520062.2 | | |
|  | 47 | | | |
|  | 48 | | | |

TABLE 30

| Duplex ID | Oligo ID | Strand | Nucleotide Sequence 5' to 3' | SEQ ID NO: |
|---|---|---|---|---|
| AD-520018.2 | A-1001193.1 | sense | gsasuaacCfuUfGfAfcuacuaaaauL96 | 1796 |
|  | A-1003737.1 | antis | asUfsuuuAfgUfAfgucaAfgGfuuaucsasu | 1797 |
| AD-519351.2 | A-999855.1 | sense | asgsgauaAfuGfUfCfuuauguaauuL96 | 1798 |
|  | A-1003070.1 | antis | asAfsuuaCfaUfAfagacAfuUfauccusasa | 1799 |
| AD-519754.2 | A-1000664.1 | sense | gsasgcugAfgUfUfGfguuuuaugauL96 | 1800 |
|  | A-1003473.1 | antis | asUfscauAfaAfAfccaaCfuCfagcucsasg | 1801 |
| AD-520062.2 | A-1001282.1 | sense | ascscuuuUfuCfAfCfcuaacuaaauL96 | 1802 |
|  | A-1003781.1 | antis | asUfsuuaGfuUfAfggugAfaAfaaggusgsu | 1803 |

TABLE 31

| Duplex | % message remaining | SD |
|---|---|---|
| PBS 10 mpk D7 | 101.3 | 18.9 |
| Naive 10 mpk D7 | 120.9 | 24.9 |
| AD-520018.2 10 mpk D7 | 41.7 | 12.3 |
| AD-519351.2 10 mpk D7 | 35.9 | 9.4 |
| AD-519754.2 10 mpk D7 | 58.6 | 6.8 |
| AD-520062.2 10 mpk D7 | 45.4 | 6.4 |
| PBS 20 mpk D8 | 100.6 | 12.4 |
| AD-520018.2 20mpk D8 | 31.8 | 5.6 |
| AD-519351.2 20mpk D8 | 27.9 | 1 |
| AD-519754.2 20mpk D | 50.5 | 4.3 |
| AD-520062.2 20mpk D8 | 49.9 | 4.3 |
| PBS 30 mpk D9 | 101.8 | 23.3 |
| AD-520018.2 30mpk D9 | 45.8 | 18.5 |
| AD-519351.2 30mpk D9 | 22.4 | 10.4 |
| AD-519754.2 30mpk D9 | 41.3 | 9.5 |
| AD-520062.2 30mpk D9 | 61.4 | 12.3 |

Example 4. Design, Synthesis and In Vitro Screening of Additional dsRNA Duplexes Additional siRNAs were designed, synthesized, and prepared using methods known in the art and described above in Example 1.

Detailed lists of the additional unmodified PNPLA3 sense and antisense strand nucleotide sequences are shown in Table 32. Detailed lists of the modified PNPLA3 sense and antisense strand nucleotide sequences are shown in Table 33.

For transfections, cells (ATCC, Manassas, Va.) were grown to near confluence at 37° C. in an atmosphere of 5% $CO_2$ in Eagle's Minimum Essential Medium (Gibco) supplemented with 10% FBS (ATCC) before being released from the plate by trypsinization. Transfection was carried out by adding 7.5 µl of Opti-MEM plus 0.1 µl of Lipofectamine RNAiMax per well (Invitrogen, Carlsbad Calif. cat #13778-150) to 2.5 µl of each siRNA duplex to an individual well in a 384-well plate. The mixture was then incubated at room temperature for 15 minutes. Forty µl of complete growth media without antibiotic containing ~1.5×10⁴ Hep3B cells were then added to the siRNA mixture. Cells were incubated for 24 hours prior to RNA purification. Single dose experiments were performed at 50, nM, 10 nM, 1 nM, and 0.1 nM final duplex concentration.

Total RNA isolation was performed using DYNABEADS. Briefly, cells were lysed in 10 µl of Lysis/Binding Buffer containing 3 µL of beads per well and mixed for 10 minutes on an electrostatic shaker. The washing steps were automated on a Biotek EL406, using a magnetic plate support. Beads were washed (in 3 µL) once in Buffer A, once in Buffer B, and twice in Buffer E, with aspiration steps in between. Following a final aspiration, complete 12 µL RT mixture was added to each well, as described below.

For cDNA synthesis, a master mix of 1.5 µl 10× Buffer, 0.6 µl 10× dNTPs, 1.51 Random primers, 0.751 Reverse Transcriptase, 0.751 RNase inhibitor and 9.91 of $H_2O$ per reaction were added per well. Plates were sealed, agitated for 10 minutes on an electrostatic shaker, and then incubated at 37 degrees C. for 2 hours. Following this, the plates were agitated at 80 degrees C. for 8 minutes.

RT-qPCR was performed as described above and relative fold change was calculated as described above.

The results of the transfection assays of the dsRNA agents listed in Tables 32 and 33 in Hep3B cells are shown in Table 34. The results of the transfection assays of the dsRNA agents listed in Tables 32 and 33 in primary cynomolgus hepatocytes (PCH) are shown in Table 35.

TABLE 32

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-518658.1 | GUCCUCUCAGAUCUUGUGCGU | 1804 | 375-395 | ACGCACAAGAUCUGAGAGGACCU | 1938 | 373-395 |
| AD-518707.1 | CAUCCAUCCUUCAACUUAAGU | 1805 | 426-446 | ACUUAAGUUGAAGGAUGGAUGGA | 1939 | 424-446 |
| AD-518708.1 | AUCCAUCCUUCAACUUAAGCU | 1806 | 427-447 | AGCUUAAGUUGAAGGAUGGAUGG | 1940 | 425-447 |
| AD-518709.1 | UCCAUCCUUCAACUUAAGCAU | 1807 | 428-448 | AUGCUUAAGUUGAAGGAUGGAUG | 1941 | 426-448 |
| AD-518722.1 | UUAAGCAAGUUCCUCCGACAU | 1808 | 441-461 | AUGUCGGAGGAACUUGCUUAAGU | 1942 | 439-461 |
| AD-518789.1 | GCAAAAUAGGCAUCUCUCUUU | 1809 | 508-528 | AAAGAGAGAUGCCUAUUUUGCCG | 1943 | 506-528 |
| AD-518791.1 | AAAAUAGGCAUCUCUCUUACU | 1810 | 510-530 | AGUAAGAGAGAUGCCUAUUUUGC | 1944 | 508-530 |
| AD-518792.1 | AAAUAGGCAUCUCUCUUACCU | 1811 | 511-531 | AGGUAAGAGAGAUGCCUAUUUUG | 1945 | 509-531 |
| AD-518794.1 | AUAGGCAUCUCUCUUACCAGU | 1812 | 513-533 | ACUGGUAAGAGAGAUGCCUAUUU | 1946 | 511-533 |
| AD-518800.1 | AUCUCUCUUACCAGAGUGUCU | 1813 | 519-539 | AGACACUCUGGUAAGAGAGAUGC | 1947 | 517-539 |
| AD-518827.1 | ACUUUCGGUCCAAAGACGAAU | 1814 | 565-585 | AUUCGUCUUUGGACCGAAAGUCA | 1948 | 563-585 |
| AD-518829.1 | UUUCGGUCCAAAGACGAAGUU | 1815 | 567-587 | AACUUCGUCUUUGGACCGAAAGU | 1949 | 565-587 |
| AD-518831.2 | CGGUCCAAAGACGAAGUCGUU | 1816 | 570-590 | AACGACUUCGUCUUUGGACCGAA | 1950 | 568-590 |
| AD-518832.2 | GGUCCAAAGACGAAGUCGUGU | 1817 | 571-591 | ACACGACUUCGUCUUUGGACCGA | 1951 | 569-591 |
| AD-518857.1 | UUGGUAUGUUCCUGCUUCAUU | 1818 | 597-617 | AAUGAAGCAGGAACAUACCAAGG | 1952 | 595-617 |
| AD-518921.2 | UGACAACGUACCCUUCAUUGU | 1819 | 683-703 | ACAAUGAAGGGUACGUUGUCACU | 1953 | 681-703 |
| AD-518922.2 | GACAACGUACCCUUCAUUGAU | 1820 | 684-704 | AUCAAUGAAGGGUACGUUGUCAC | 1954 | 682-704 |
| AD-518923.2 | ACAACGUACCCUUCAUUGAUU | 1821 | 685-705 | AAUCAAUGAAGGGUACGUUGUCA | 1955 | 683-705 |
| AD-518924.2 | CAACGUACCCUUCAUUGAUGU | 1822 | 686-706 | ACAUCAAUGAAGGGUACGUUGUC | 1956 | 684-706 |
| AD-518925.2 | AACGUACCCUUCAUUGAUGCU | 1823 | 687-707 | AGCAUCAAUGAAGGGUACGUUGU | 1957 | 685-707 |
| AD-518967.1 | UAAAGUCAAGUCCACGAACUU | 1824 | 758-778 | AAGUUCGUGGACUUGACUUUAGG | 1958 | 756-778 |
| AD-518968.1 | AAAGUCAAGUCCACGAACUUU | 1825 | 759-779 | AAAGUUCGUGGACUUGACUUUAG | 1959 | 757-779 |
| AD-518976.1 | UCCACGAACUUUCUUCAUGUU | 1826 | 768-788 | AACAUGAAGAAAGUUCGUGGACU | 1960 | 766-788 |
| AD-518977.1 | CCACGAACUUUCUUCAUGUGU | 1827 | 769-789 | ACACAUGAAGAAAGUUCGUGGAC | 1961 | 767-789 |
| AD-518978.1 | CACGAACUUUCUUCAUGUGGU | 1828 | 770-790 | ACCACAUGAAGAAAGUUCGUGGA | 1962 | 768-790 |
| AD-518979.1 | ACGAACUUUCUUCAUGUGGAU | 1829 | 771-791 | AUCCACAUGAAGAAAGUUCGUGG | 1963 | 769-791 |
| AD-518980.2 | CGAACUUUCUUCAUGUGGACU | 1830 | 772-792 | AGUCCACAUGAAGAAAGUUCGUG | 1964 | 770-792 |
| AD-519043.1 | UUCUCUCGAGAGCUUUUGUCU | 1831 | 835-855 | AGACAAAAGCUCUCGAGAGAAGG | 1965 | 833-855 |
| AD-519340.1 | UGCUACCCAUUAGGAUAAUGU | 1832 | 1207-1227 | ACAUUAUCCUAAUGGGUAGCAAG | 1966 | 1205-1227 |
| AD-519341.1 | GCUACCCAUUAGGAUAAUGUU | 1833 | 1208-1228 | AACAUUAUCCUAAUGGGUAGCAA | 1967 | 1206-1228 |
| AD-519342.1 | CUACCCAUUAGGAUAAUGUCU | 1834 | 1209-1229 | AGACAUUAUCCUAAUGGGUAGCA | 1968 | 1207-1229 |
| AD-519343.1 | UACCCAUUAGGAUAAUGUCUU | 1835 | 1210-1230 | AAGACAUUAUCCUAAUGGGUAGC | 1969 | 1208-1230 |
| AD-519344.1 | ACCCAUUAGGAUAAUGUCUUU | 1836 | 1211-1231 | AAAGACAUUAUCCUAAUGGGUAG | 1970 | 1209-1231 |
| AD-519349.1 | UUAGGAUAAUGUCUUUAUGAU | 1837 | 1216-1236 | AUACAUAAGACAUUAUCCUAAUG | 1971 | 1214-1236 |
| AD-519350.1 | UAGGAUAAUGUCUUUAUGUAAU | 1838 | 1217-1237 | AUUACAUAAGACAUUAUCCUAAU | 1972 | 1215-1237 |
| AD-519477.1 | UCACAGGUGUUCACUCGAGUU | 1839 | 1344-1364 | AACUCGAGUGAACACCUGUGAGG | 1973 | 1342-1364 |
| AD-519596.1 | CUUGGGCAAUAAAGUACCUGU | 1840 | 1544-1564 | ACAGGUACUUUAUUGCCCAAGAA | 1974 | 1542-1564 |

TABLE 32-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-519622.1 | UUCCCAGUUUUUCACUAGAGU | 1841 | 1588-1608 | ACUCUAGUGAAAAACUGGGAAAG | 1975 | 1586-1608 |
| AD-519666.1 | GGCGAGUCUAGCAGAUUCUUU | 1842 | 1632-1652 | AAAGAAUCUGCUAGACUCGCCUC | 1976 | 1630-1652 |
| AD-519667.1 | GCGAGUCUAGCAGAUUCUUUU | 1843 | 1633-1653 | AAAAGAAUCUGCUAGACUCGCCU | 1977 | 1631-1653 |
| AD-519668.1 | CGAGUCUAGCAGAUUCUUUCU | 1844 | 1634-1654 | AGAAAGAAUCUGCUAGACUCGCC | 1978 | 1632-1654 |
| AD-519669.1 | GAGUCUAGCAGAUUCUUUCAU | 1845 | 1635-1655 | AUGAAAGAAUCUGCUAGACUCGC | 1979 | 1633-1655 |
| AD-519670.1 | AGUCUAGCAGAUUCUUUCAGU | 1846 | 1636-1656 | ACUGAAAGAAUCUGCUAGACUCG | 1980 | 1634-1656 |
| AD-519671.1 | GUCUAGCAGAUUCUUUCAGAU | 1847 | 1637-1657 | AUCUGAAAGAAUCUGCUAGACUC | 1981 | 1635-1657 |
| AD-519672.1 | UCUAGCAGAUUCUUUCAGAGU | 1848 | 1638-1658 | ACUCUGAAAGAAUCUGCUAGACU | 1982 | 1636-1658 |
| AD-519691.1 | UGCUAAAGUUUCCCAUCUUUU | 1849 | 1659-1679 | AAAAGAUGGGAAACUUUAGCACC | 1983 | 1657-1679 |
| AD-519692.1 | GCUAAAGUUUCCCAUCUUUGU | 1850 | 1660-1680 | ACAAAGAUGGGAAACUUUAGCAC | 1984 | 1658-1680 |
| AD-519693.1 | CUAAAGUUUCCCAUCUUUGUU | 1851 | 1661-1681 | AACAAAGAUGGGAAACUUUAGCA | 1985 | 1659-1681 |
| AD-519694.1 | UAAAGUUUCCCAUCUUUGUGU | 1852 | 1662-1682 | ACACAAAGAUGGGAAACUUUAGC | 1986 | 1660-1682 |
| AD-519696.1 | AGUUUCCCAUCUUUGUGCAU | 1853 | 1664-1684 | AUGCACAAAGAUGGGAAACUUUA | 1987 | 1662-1684 |
| AD-67554.6 | UCUGAGCUGAGUUGGUUUUAU | 1854 | 1740-1760 | AUAAAACCAACUCAGCUCAGAGG | 1988 | 1738-1760 |
| AD-519752.2 | CUGAGCUGAGUUGGUUUUAUU | 1855 | 1741-1761 | AAUAAAACCAACUCAGCUCAGAG | 1989 | 1739-1761 |
| AD-519753.2 | UGAGCUGAGUUGGUUUUAUGU | 1856 | 1742-1762 | ACAUAAAACCAACUCAGCUCAGA | 1990 | 1740-1762 |
| AD-519754.8 | GAGCUGAGUUGGUUUUAUGAU | 1857 | 1743-1763 | AUCAUAAAACCAACUCAGCUCAG | 1991 | 1741-1763 |
| AD-519755.4 | AGCUGAGUUGGUUUUAUGAAU | 1858 | 1744-1764 | AUUCAUAAAACCAACUCAGCUCA | 1992 | 1742-1764 |
| AD-519759.2 | GAGUUGGUUUUAUGAAAAGCU | 1859 | 1748-1768 | AGCUUUUCAUAAAACCAACUCAG | 1993 | 1746-1768 |
| AD-519760.2 | AGUUGGUUUUAUGAAAAGCUU | 1860 | 1749-1769 | AAGCUUUUCAUAAAACCAACUCA | 1994 | 1747-1769 |
| AD-519761.2 | GUUGGUUUUAUGAAAAGCUAU | 1861 | 1750-1770 | AUAGCUUUUCAUAAAACCAACUC | 1995 | 1748-1770 |
| AD-519766.2 | UUUUAUGAAAAGCUAGGAAGU | 1862 | 1755-1775 | ACUUCCUAGCUUUUCAUAAAACC | 1996 | 1753-1775 |
| AD-519773.1 | AAAAGCUAGGAAGCAACCUUU | 1863 | 1762-1782 | AAAGGUUGCUUCCUAGCUUUUCA | 1997 | 1760-1782 |
| AD-519776.1 | AGCUAGGAAGCAACCUUUCGU | 1864 | 1765-1785 | ACGAAAGGUUGCUUCCUAGCUUU | 1998 | 1763-1785 |
| AD-519777.1 | GCUAGGAAGCAACCUUUCGCU | 1865 | 1766-1786 | AGCGAAAGGUUGCUUCCUAGCUU | 1999 | 1764-1786 |
| AD-519779.1 | UAGGAAGCAACCUUUCGCCUU | 1866 | 1768-1788 | AAGGCGAAAGGUUGCUUCCUAGC | 2000 | 1766-1788 |
| AD-519809.1 | CCAGCACUUAACUCUAAUACU | 1867 | 1798-1818 | AGUAUUAGAGUUAAGUGCUGGAC | 2001 | 1796-1818 |
| AD-519810.1 | CAGCACUUAACUCUAAUACAU | 1868 | 1799-1819 | AUGUAUUAGAGUUAAGUGCUGGA | 2002 | 1797-1819 |
| AD-519811.1 | AGCACUUAACUCUAAUACAUU | 1869 | 1800-1820 | AAUGUAUUAGAGUUAAGUGCUGG | 2003 | 1798-1820 |
| AD-519814.1 | ACUUAACUCUAAUACAUCAGU | 1870 | 1803-1823 | ACUGAUGUAUUAGAGUUAAGUGC | 2004 | 1801-1823 |
| AD-519820.1 | CUCUAAUACAUCAGCAUGCGU | 1871 | 1809-1829 | ACGCAUGCUGAUGUAUUAGAGUU | 2005 | 1807-1829 |
| AD-519821.1 | UCUAAUACAUCAGCAUGCGUU | 1872 | 1810-1830 | AACGCAUGCUGAUGUAUUAGAGU | 2006 | 1808-1830 |
| AD-519822.1 | CUAAUACAUCAGCAUGCGUUU | 1873 | 1811-1831 | AAACGCAUGCUGAUGUAUUAGAG | 2007 | 1809-1831 |
| AD-519823.1 | UAAUACAUCAGCAUGCGUUAU | 1874 | 1812-1832 | AUAACGCAUGCUGAUGUAUUAGA | 2008 | 1810-1832 |
| AD-519826.1 | UACAUCAGCAUGCGUUAAUUU | 1875 | 1815-1835 | AAAUUAACGCAUGCUGAUGUAUU | 2009 | 1813-1835 |
| AD-519827.1 | ACAUCAGCAUGCGUUAAUUCU | 1876 | 1816-1836 | AGAAUUAACGCAUGCUGAUGUAU | 2010 | 1814-1836 |
| AD-519828.3 | CAUCAGCAUGCGUUAAUUCAU | 1877 | 1817-1837 | AUGAAUUAACGCAUGCUGAUGUA | 2011 | 1815-1837 |

TABLE 32-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-519830.1 | UCAGCAUGCGUUAAUUCAGCU | 1878 | 1819-1839 | AGCUGAAUUAACGCAUGCUGAUG | 2012 | 1817-1839 |
| AD-519832.1 | AGCAUGCGUUAAUUCAGCUGU | 1879 | 1821-1841 | ACAGCUGAAUUAACGCAUGCUGA | 2013 | 1819-1841 |
| AD-519887.1 | GUCCCUUACUGACUGUUUCGU | 1880 | 1876-1896 | ACGAAACAGUCAGUAAGGGACCC | 2014 | 1874-1896 |
| AD-519888.1 | UCCCUUACUGACUGUUUCGUU | 1881 | 1877-1897 | AACGAAACAGUCAGUAAGGGACC | 2015 | 1875-1897 |
| AD-519889.1 | CCCUUACUGACUGUUUCGUGU | 1882 | 1878-1898 | ACACGAAACAGUCAGUAAGGGAC | 2016 | 1876-1898 |
| AD-519890.1 | CCUUACUGACUGUUUCGUGGU | 1883 | 1879-1899 | ACCACGAAACAGUCAGUAAGGGA | 2017 | 1877-1899 |
| AD-519929.1 | UUCCAGCAUGAGGUUCUUAGU | 1884 | 1919-1939 | ACUAAGAACCUCAUGCUGGAACA | 2018 | 1917-1939 |
| AD-519931.1 | CCAGCAUGAGGUUCUUAGAAU | 1885 | 1921-1941 | AUUCUAAGAACCUCAUGCUGGAA | 2019 | 1919-1941 |
| AD-519932.1 | CAGCAUGAGGUUCUUAGAAUU | 1886 | 1922-1942 | AAUUCUAAGAACCUCAUGCUGGA | 2020 | 1920-1942 |
| AD-519933.1 | AGCAUGAGGUUCUUAGAAUGU | 1887 | 1923-1943 | ACAUUCUAAGAACCUCAUGCUGG | 2021 | 1921-1943 |
| AD-519935.2 | CAUGAGGUUCUUAGAAUGACU | 1888 | 1925-1945 | AGUCAUUCUAAGAACCUCAUGCU | 2022 | 1923-1945 |
| AD-519942.1 | UUCUUAGAAUGACAGGUGUUU | 1889 | 1932-1952 | AAACACCUGUCAUUCUAAGAACC | 2023 | 1930-1952 |
| AD-520005.1 | GGUCUGCAAAGAUGAUAACCU | 1890 | 2097-2117 | AGGUUAUCAUCUUUGCAGACCAC | 2024 | 2095-2117 |
| AD-520006.1 | GUCUGCAAAGAUGAUAACCUU | 1891 | 2098-2118 | AAGGUUAUCAUCUUUGCAGACCA | 2025 | 2096-2118 |
| AD-520007.1 | UCUGCAAAGAUGAUAACCUUU | 1892 | 2099-2119 | AAAGGUUAUCAUCUUUGCAGACC | 2026 | 2097-2119 |
| AD-520008.1 | CUGCAAAGAUGAUAACCUUGU | 1893 | 2100-2120 | ACAAGGUUAUCAUCUUUGCAGAC | 2027 | 2098-2120 |
| AD-520011.1 | CAAAGAUGAUAACCUUGACUU | 1894 | 2103-2123 | AAGUCAAGGUUAUCAUCUUUGCA | 2028 | 2101-2123 |
| AD-520020.1 | UAACCUUGACUACUAAAAACU | 1895 | 2112-2132 | AGUUUUUAGUAGUCAAGGUUAUC | 2029 | 2110-2132 |
| AD-520021.1 | AACCUUGACUACUAAAAACGU | 1896 | 2113-2133 | ACGUUUUUAGUAGUCAAGGUUAU | 2030 | 2111-2133 |
| AD-520022.1 | ACCUUGACUACUAAAAACGUU | 1897 | 2114-2134 | AACGUUUUUAGUAGUCAAGGUUA | 2031 | 2112-2134 |
| AD-520023.1 | CCUUGACUACUAAAAACGUCU | 1898 | 2115-2135 | AGACGUUUUUAGUAGUCAAGGUU | 2032 | 2113-2135 |
| AD-520024.1 | CUUGACUACUAAAAACGUCUU | 1899 | 2116-2136 | AAGACGUUUUUAGUAGUCAAGGU | 2033 | 2114-2136 |
| AD-520025.1 | UUGACUACUAAAAACGUCUCU | 1900 | 2117-2137 | AGAGACGUUUUUAGUAGUCAAGG | 2034 | 2115-2137 |
| AD-520034.1 | GGGUAACAAGAUGAUAAUCUU | 1901 | 2145-2165 | AAGAUUAUCAUCUUGUUACCCCC | 2035 | 2143-2165 |
| AD-520035.3 | GGUAACAAGAUGAUAAUCUAU | 1902 | 2146-2166 | AUAGAUUAUCAUCUUGUUACCCC | 2036 | 2144-2166 |
| AD-520036.1 | GUAACAAGAUGAUAAUCUACU | 1903 | 2147-2167 | AGUAGAUUAUCAUCUUGUUACCC | 2037 | 2145-2167 |
| AD-520037.1 | UAACAAGAUGAUAAUCUACUU | 1904 | 2148-2168 | AAGUAGAUUAUCAUCUUGUUACC | 2038 | 2146-2168 |
| AD-520038.1 | AACAAGAUGAUAAUCUACUUU | 1905 | 2149-2169 | AAAGUAGAUUAUCAUCUUGUUAC | 2039 | 2147-2169 |
| AD-520053.1 | UUUUAGAACACCUUUUUCACU | 1906 | 2171-2191 | AGUGAAAAGGUGUUCUAAAAUU | 2040 | 2169-2191 |
| AD-520060.3 | ACACCUUUUUCACCUAACUAU | 1907 | 2178-2198 | AUAGUUAGGUGAAAAGGUGUUC | 2041 | 2176-2198 |
| AD-520061.3 | CACCUUUUUCACCUAACUAAU | 1908 | 2179-2199 | AUUAGUUAGGUGAAAAGGUGUU | 2042 | 2177-2199 |
| AD-520064.5 | CUUUUUCACCUAACUAAAAUU | 1909 | 2182-2202 | AAUUUUAGUUAGGUGAAAAGGU | 2043 | 2180-2202 |
| AD-520065.4 | UUUUUCACCUAACUAAAAUAU | 1910 | 2183-2203 | AUAUUUAGUUAGGUGAAAAGG | 2044 | 2181-2203 |
| AD-520066.2 | UUUUCACCUAACUAAAAUAAU | 1911 | 2184-2204 | AUUAUUUAGUUAGGUGAAAAG | 2045 | 2182-2204 |
| AD-520067.3 | UUUCACCUAACUAAAAUAAUU | 1912 | 2185-2205 | AAUUAUUUAGUUAGGUGAAAA | 2046 | 2183-2205 |
| AD-75289.4 | UUCACCUAACUAAAAUAAUGU | 1913 | 2186-2206 | ACAUUAUUUAGUUAGGUGAAA | 2047 | 2184-2206 |
| AD-520068.3 | UCACCUAACUAAAAUAAUGUU | 1914 | 2187-2207 | AACAUUAUUUAGUUAGGUGAAA | 2048 | 2185-2207 |

TABLE 32-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-520069.3 | CACCUAACUAAAAUAAUGUUU | 1915 | 2188-2208 | AAACAUUAUUUUAGUUAGGUGAA | 2049 | 2186-2208 |
| AD-520087.1 | AUGUAAGGAAGCGUUGUUACU | 1916 | 2227-2247 | AGUAACAACGCUUCCUUACAUUU | 2050 | 2225-2247 |
| AD-520095.1 | AAGCGUUGUUACCUGUUGAAU | 1917 | 2235-2255 | AUUCAACAGGUAACAACGCUUCC | 2051 | 2233-2255 |
| AD-520096.1 | AGCGUUGUUACCUGUUGAAUU | 1918 | 2236-2256 | AAUUCAACAGGUAACAACGCUUC | 2052 | 2234-2256 |
| AD-520098.2 | GUUGUUACCUGUUGAAUUUUU | 1919 | 2239-2259 | AAAAAUUCAACAGGUAACAACGC | 2053 | 2237-2259 |
| AD-75256.2 | UUGUUACCUGUUGAAUUUUGU | 1920 | 2240-2260 | ACAAAAUUCAACAGGUAACAACG | 2054 | 2238-2260 |
| AD-520099.3 | UGUUACCUGUUGAAUUUUGUU | 1921 | 2241-2261 | AACAAAAUUCAACAGGUAACAAC | 2055 | 2239-2261 |
| AD-67575.8 | UUACCUGUUGAAUUUUGUAUU | 1922 | 2243-2263 | AAUACAAAAUUCAACAGGUAACA | 2056 | 2241-2263 |
| AD-520101.3 | UACCUGUUGAAUUUUGUAUUU | 1923 | 2244-2264 | AAAUACAAAAUUCAACAGGUAAC | 2057 | 2242-2264 |
| AD-67605.8 | ACCUGUUGAAUUUUGUAUUAU | 1924 | 2245-2265 | AUAAUACAAAAUUCAACAGGUAA | 2058 | 2243-2265 |
| AD-520102.1 | CUGUUGAAUUUUGUAUUAUGU | 1925 | 2247-2267 | ACAUAAUACAAAAUUCAACAGGU | 2059 | 2245-2267 |
| AD-520103.1 | GUUGAAUUUUGUAUUAUGUGU | 1926 | 2249-2269 | ACACAUAAUACAAAAUUCAACAG | 2060 | 2247-2269 |
| AD-520123.1 | CAGUGAGAUGUUAGUAGAAUU | 1927 | 2272-2292 | AAUUCUACUAACAUCUCACUGAU | 2061 | 2270-2292 |
| AD-520127.1 | GAGAUGUUAGUAGAAUAAGCU | 1928 | 2276-2296 | AGCUUAUUCUACUAACAUCUCAC | 2062 | 2274-2296 |
| AD-520133.1 | UAGUAGAAUAAGCCUUAAAAU | 1929 | 2283-2303 | AUUUUAAGGCUUAUUCUACUAAC | 2063 | 2281-2303 |
| AD-520350.1 | GCUGAGAUUGCACCAUUUCAU | 1930 | 2542-2562 | AUGAAAUGGUGCAAUCUCAGCUC | 2064 | 2540-2562 |
| AD-520351.1 | CUGAGAUUGCACCAUUUCAUU | 1931 | 2543-2563 | AAUGAAAUGGUGCAAUCUCAGCU | 2065 | 2541-2563 |
| AD-520352.2 | UGAGAUUGCACCAUUUCAUUU | 1932 | 2544-2564 | AAAUGAAAUGGUGCAAUCUCAGC | 2066 | 2542-2564 |
| AD-520354.1 | AGAUUGCACCAUUUCAUUCCU | 1933 | 2546-2566 | AGGAAUGAAAUGGUGCAAUCUCA | 2067 | 2544-2566 |
| AD-520391.1 | AACAAAUAAUCUAGUGUGCU | 1934 | 2616-2636 | AGCACACUAGAUUAUUUGUUUU | 2068 | 2614-2636 |
| AD-520393.1 | CAAAUAAUCUAGUGUGCAGU | 1935 | 2618-2638 | ACUGCACACUAGAUUAUUUGUU | 2069 | 2616-2638 |
| AD-520467.2 | UUGAACCUGGCUUAUUUUCUU | 1936 | 2714-2734 | AAGAAAAUAAGCCAGGUUCAAGU | 2070 | 2712-2734 |
| AD-520481.1 | CACAUGGUCAGUGAGUUUCUU | 1937 | 2748-2768 | AAGAAACUCACUGACCAUGUGG | 2071 | 2746-2768 |

TABLE 33

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-518658.1 | gsuscucUfcAfGfAfaucuugugcguL96 | 2072 | asCfsgcacCfaAfGfaucuGfaGfaggacscsu | 2206 | AGGUCCUCCAGAUCUUGUGCGG | 2340 |
| AD-518707.1 | csasuccaUfccCfUfUfcaacuuaaguL96 | 2073 | asCfsuuaAfgUfUfgaagGfaUfggaugsgsa | 2207 | UCCAUCCAUCCUUCAACUUAAGC | 2341 |
| AD-518708.1 | asuscccauUfcUfUfCfaacuuaagcuL96 | 2074 | asGfscuuAfaGfUfugaaGfaAfuggausgsg | 2208 | CCAUCCAUCCUUCAACUUAAGCA | 2342 |
| AD-518709.1 | uscscaucCfuuUfCfAfacuuaagcauL96 | 2075 | asUfsgcuUfaAfGfuugaAfgGfauggasusg | 2209 | CAUCCAUCCUUCAACUUAAGCAA | 2343 |
| AD-518722.1 | ususuaagcAfaGfUfUfcccuccgacauL96 | 2076 | asUfsgucGfgfGfAfGfgaacUfuGfcuuaasgsu | 2210 | ACUUAAGCAAGUCCUCCCGACAG | 2344 |
| AD-518789.1 | gscsaaaaUfaGfGfCfaucucucuuuL96 | 2077 | asAfsagaGfaGfAfugccUfaUfuuugcscsg | 2211 | CGGCAAAAUAGGCAUCUCUCUUA | 2345 |
| AD-518791.1 | asasaauaGfgCfAfUfCfucucuacuL96 | 2078 | asGfsuaaGfaGfAfgaugCfcUfauuuusgsc | 2212 | GCAAAAUAGGCAUCUCUCUUACC | 2346 |
| AD-518792.1 | asasauagGfcAfUfCfucucuaccuL96 | 2079 | asGfsguaAfgAfGfagauGfccUfauuuususg | 2213 | CAAAAUAGGCAUCUCUCUUACCA | 2347 |
| AD-518794.1 | asusaggcAfuCfUfCfucuuaccaguL96 | 2080 | asCfsuggUfaAfGfagagAfuGfccuaususu | 2214 | AAAUAGGCAUCUCUCUUACCAGA | 2348 |
| AD-518800.1 | asuscucuCfuUfAfCfcagagugucuL96 | 2081 | asGfsacaCfuCfUfggtaAfgAfagausgsc | 2215 | GCAUCUCUCUUACCAGAGUGUCU | 2349 |
| AD-518827.1 | ascsuuucCfgUfcCfCfaaagacgaauL96 | 2082 | asUfsucgUfcUfUfuggaCfcGfaaaguscsa | 2216 | UGACUUCGGUCCAAAGACGAAAG | 2350 |
| AD-518829.1 | ususucggUfccCfAfAfAfagacgaaguuL96 | 2083 | asAfscuuCfgUfCfuuugGfaCfcgaaasgsu | 2217 | ACUUUCGGUCCAAAGACGAAGUC | 2351 |
| AD-518831.2 | csgggtccAfaAfAfGfAfcgaagucguuL96 | 2084 | asAfscgaCfuuUfCfgucUfuUfGfgaccgsasa | 2218 | UUCGGUCCAAAGACGAAGUCGUG | 2352 |
| AD-518832.2 | gsgguccaAfaGfAfCfgaagucguguL96 | 2085 | asCfsacgAfcUfUfcgucUfuUfgguccsgsa | 2219 | UCGGUCCAAAGACGAAGUCGUGG | 2353 |
| AD-518857.1 | ususgguaUfgUfUfCfcugcucauuL96 | 2086 | asAfsugaAfgGfCfAfggaaCfaUfaccaasgsg | 2220 | CCUUGGUAUGUUCCUGCUCAUC | 2354 |
| AD-518921.2 | usgsgacaaCfgUfAfCfccuucauuguL96 | 2087 | asCfsaauGfaAfGfgguaCfgUfugucascsu | 2221 | AGUGACAACGUACCCUUCAUUGA | 2355 |
| AD-518922.2 | gsascaacGfuAfCfCfcuucauugauL96 | 2088 | asUfscaaUfgAfAfgggUfaCfGfuugucsasc | 2222 | GUGACAACGUACCCUUCAUUGAU | 2356 |
| AD-518923.2 | ascsaacgUfaCfCfCfuucauugauuL96 | 2089 | asAfsucaAfuGfAfagggUfaCfguugscsa | 2223 | UGACAACGUACCCUUCAUUGAUG | 2357 |
| AD-518924.2 | csaascguAfcCfCfUfucauugauguL96 | 2090 | asCfsaucAfuCfAfAfugggfuAfcGfuugsusc | 2224 | GACAACGUACCCUUCAUUGAUGC | 2358 |
| AD-518925.2 | asascguaCfccCfUfUfcauugaugcuL96 | 2091 | asGfscauCfaAfUfGfgaagfGfaUfacguusgsu | 2225 | ACAACGUACCCUUCAUUGAUGCC | 2359 |
| AD-518967.1 | usaaaguCfaAfGfUfccacgaacuuL96 | 2092 | asGfsuucGfuGfGfacUfGfacuuuasgsg | 2226 | CCUAAAGUCAAGUCCACGAACUU | 2360 |
| AD-518968.1 | asasaguCfaAfGfUfCfcacgaacuuuL96 | 2093 | asAfsaguUfcGfUfGfgacUfGfacuuusasg | 2227 | CUAAAGUCAAGUCCACGAACUUU | 2361 |
| AD-518976.1 | uscscacgAfaCfUfUfucucaugugL96 | 2094 | asAfscauGfaAfGfaaagUfuCfguggascsu | 2228 | AGUCCACGAACUUUCUCAUGUG | 2362 |
| AD-518977.1 | cscscagaAfcUfUfUfcuucauguguL96 | 2095 | asCfsacaUfcUfUfcuucauguguGfcuuL96 | 2229 | GUCCACGAACUUUCUCAUGUGG | 2363 |

TABLE 33-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-518978.1 | csascgaaCfuUfUfCfuucaugugguL96 | 2096 | asCfscacAfuGfAfagaaAfgUfucgugsgsa | 2230 | UCCACGAACUUUCUUCAUGUGGA | 2364 |
| AD-518979.1 | ascsgaacUfuUfCfUfUfucauguggauL96 | 2097 | asUfsccaCfaUfGfaagaAfaGfuucgusgsg | 2231 | CCACGAACUUUCUUCAUGUGGAC | 2365 |
| AD-518980.2 | csgsaacuUfucCfUfUfcaugugacuL96 | 2098 | asGfsuccAfcAfcUfgaagAfaAfguucgsusg | 2232 | CACGAACUUUCUUCAUGUGGACA | 2366 |
| AD-519043.1 | ususcucuCfgAfGfAfgcuuuugucuL96 | 2099 | asGfsacaAfaAfAfGfcucuCfgAfgagaasgsg | 2233 | CCUCUCCGAGAGCUUUGUCC | 2367 |
| AD-519340.1 | usgsuaccCfcAfUfUfAfggauaauguL96 | 2100 | asCfsauuAfucCfcuaauGfgGfuagcasasg | 2234 | CUUGCUACCCAUUAGGAUAAUGU | 2368 |
| AD-519341.1 | gscsuaccCfaUfUfAfggauaaugucuL96 | 2101 | asAfscauUfaUfCfcuaaUfgGfuagcsasa | 2235 | UUGCUACCCAUUAGGAUAAUGUC | 2369 |
| AD-519342.1 | csusaccCfuUfAfGfgauaaugucuL96 | 2102 | asGfsacaUfuAfUfUfccuaAfuGfgguagcsa | 2236 | UGCUACCCAUUAGGAUAAUGUCU | 2370 |
| AD-519343.1 | usascccaUfuAfGfGfauaaugucuuL96 | 2103 | asAfsgaCfaUfUfAfuccuAfuGfgguasgsc | 2237 | GCUACCCAUUAGGAUAAUGUCUU | 2371 |
| AD-519344.1 | ascsccauUfaGfGfAfuaaugucuuuL96 | 2104 | asAfsagaCfaUfUfAfuaccuUfaAfuggusasg | 2238 | CUACCCAUUAGGAUAAUGUCUUA | 2372 |
| AD-519349.1 | ususaggaUfaAfUfGfucuuaauguL96 | 2105 | asUfsacaAfaAfGfacauUfaUfcccuaasasu | 2239 | CAUUAGGAUAAUGUCUUAUGUAA | 2373 |
| AD-519350.1 | usasggauAfaUfGfUfcuuaauguauL96 | 2106 | asUfsuacAfaUfAfAfgacaUfuAfuccuasasu | 2240 | AUUAGGAUAAUGUCUUAUGUAAU | 2374 |
| AD-519477.1 | uscsacagGfuGfUfUfcacucgaguL96 | 2107 | asAfsctcCfaGfUfgaacAfcCfugugasgsg | 2241 | CCCACAGGUGUUCACUCGAGUG | 2375 |
| AD-519596.1 | csusuggGfcaAfUfAfAfaguaccgsc | 2108 | asGfsaggUfaCfUfUfuauUfgCfccaagsasa | 2242 | UUCUGGGCAAUAAAGUACCGC | 2376 |
| AD-519622.1 | ususcccaGfuUfUfUfcacuagaguL96 | 2109 | asCfsucuAfgUfGfaaaaAfcUfgggaasasg | 2243 | CUUUCCCAGUUUUCACUAGAGA | 2377 |
| AD-519666.1 | gsgscgagUfcUfAfGfcagauucuuuL96 | 2110 | asAfsagaAfucUfCfugcuAfgAfcucgccsusc | 2244 | GAGGCGAGCUAGCAGAUUCUUU | 2378 |
| AD-519667.1 | gscsgagUfcuAfGfCfagauucuuucL96 | 2111 | asAfsaagAfaUfCfugcuAfgAfcucgcscsu | 2245 | AGGCGAGUCUAGCAGAUUCUUUC | 2379 |
| AD-519668.1 | csgsagucUfaGfCfAfgauucuuucaL96 | 2112 | asGfsaaaGfaAfUfcugcUfaGfacucgscsc | 2246 | GGCGAGUCUAGCAGAUUCUUUCA | 2380 |
| AD-519669.1 | gsasgucUfagCfAfGfAfauucuuucagL96 | 2113 | asUfsgaaAfgAfAfucugCfuAfgacucsgsc | 2247 | GCGAGUCUAGCAGAUUCUUUCAG | 2381 |
| AD-519670.1 | asgsucuaGfcAfGfAfauucuuucaugL96 | 2114 | asCfsugaAfaGfAfaucuGfcUfagacuscsg | 2248 | CGAGUCUAGCAGAUUCUUUCAGA | 2382 |
| AD-519671.1 | gsuscuagCfaGfAfUfUfcuuucagauL96 | 2115 | asCfstugaAfaGfaaucUfgCfuagacsusc | 2249 | GAGUCUAGCAGAUUCUUUCAGAG | 2383 |
| AD-519672.1 | uscsuagcAfgAfUfUfcuuucagagauL96 | 2116 | asCfstucuGfaAfAfgaauCfuGfcuagasgsu | 2250 | AGUCUAGCAGAUUCUUUCAGAGG | 2384 |
| AD-519691.1 | usgscuaaAfgUfUfUfccaucuuugL96 | 2117 | asAfsaagAfaGfGfgaaaCfuUfuagcascsc | 2251 | GGUGCUAAAGUUUCCCAUCUUUG | 2385 |
| AD-519692.1 | gscsuaaAfgUfUfUfCfccaucuuuguL96 | 2118 | asCfsaaaGfaUfGfggaaAfcUfuuuagcsasc | 2252 | GUGCUAAAGUUUCCCAUCUUUGU | 2386 |
| AD-519693.1 | csusaaagUfuUfCfCfcaucuuuguL96 | 2119 | asAfscaaAfgAfUfUfgggaAfaCfuuuagscsa | 2253 | UGCUAAAGUUUCCCAUCUUUGUG | 2387 |

TABLE 33-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-519694.1 | usasaaguUfuCfcFfaucuuuguguL96 | 2120 | asCfsacaAfaGfAfugggAfaAfcuuuasgsc | 2254 | GCUAAAGUUUCCCAUCUUUGUGC | 2388 |
| AD-519696.1 | asasguuuCfccFfAfUfcuuugugcauL96 | 2121 | asUfsgcaCfaAfAfgaugGfgAfaacuususa | 2255 | UAAAGUUUCCCAUCUUUGUGCAG | 2389 |
| AD-67554.6 | uscsugagCfugFfAfGfuugguuuauauL96 | 2122 | asUfsaaaAfcCfAfacucAfgCfucagasgsg | 2256 | CCCUGAGCUGAGUUGGUUUAU | 2390 |
| AD-519752.2 | csusgagcUfgAfGfUfugguuuuauuL96 | 2123 | asAfsuaaAfaCfCfaacuCfaGfcucagsasg | 2257 | CUCUGAGCUGAGUUGGUUUAUG | 2391 |
| AD-519753.2 | usgsagcUfgAfGfUfUfgguuuuauguL96 | 2124 | asCfsauaAfaAfAfCfcaacUfcAfgcucasga | 2258 | UCUGAGCUGAGUUGGUUUAUGA | 2392 |
| AD-519754.8 | gsasgcugAfgUfUfGfgguuuauguaL96 | 2125 | asUfscauAfaAfAfAfccaaCfuCfagcucsag | 2259 | CUGAGCUGAGUUGGUUUAUGAA | 2393 |
| AD-519755.4 | asgscugaGfuUfGfGfuuuuaugaauL96 | 2126 | asUfsucaUfaAfAfAfaccaAfcUfcagcucsa | 2260 | UGAGCUGAGUUGGUUUAUGAAA | 2394 |
| AD-519759.2 | gsasguugGfuUfUfUfaugaaaagcuL96 | 2127 | asGfscuuUfuCfAfuaaaAfcCfaacucsasg | 2261 | CUGAGUUGGUUUAUGAAAAGCU | 2395 |
| AD-519760.2 | asgsuuggUfuUfUfAfugaaaagcuuL96 | 2128 | asAfsgcuUfuUfCfauaaAfaCfcaacucsa | 2262 | UGAGUUGGUUUAUGAAAAGCUA | 2396 |
| AD-519761.2 | gsusugguUfuUfAfUfgaaaagcuauL96 | 2129 | asUfsagcUfuUfUfcauaAfaAfccaacusc | 2263 | GAGUUGGUUUAUGAAAAGCUAG | 2397 |
| AD-519766.2 | usuuuauGfaAfAfAfgcuaggaaguL96 | 2130 | asCfsuuccUfuAfGfcuuuUfcAfuaaaascsc | 2264 | GGUUUAUGAAAAGCUAGGAAGC | 2398 |
| AD-519773.1 | asasaaagCfuaGfGfAfagcaaccuuL96 | 2131 | asAfsaggUfuGfCfuuccUfuAfgcuuuuscsa | 2265 | UGAAAAGCUAGGAAGCAACCUUU | 2399 |
| AD-519776.1 | asgscuagGfaAfGfCfAfaccuuucguL96 | 2132 | asCfsgaaAfgGfUfugcuUfcCfuagcususu | 2266 | AAAGCUAGGAAGCAACCUUUCGC | 2400 |
| AD-519777.1 | gscsuaggAfaGfCfAfAfccuuucgcuL96 | 2133 | asGfscgaAfaGfGfuugcUfuCfcuagcsusu | 2267 | AAGCUAGGAAGCAACCUUUCGCC | 2401 |
| AD-519779.1 | usasggaaGfcAfAfCfcuuucgccuL96 | 2134 | asAfsggcGfaAfAfggugUfcGfuuccuasgsc | 2268 | GCUAGGAAGCAACCUUUCGCCUG | 2402 |
| AD-519809.1 | cscsagcaCfuUfAfAfcucuaauacuL96 | 2135 | asGfsuauUfaGfAfguuaAfgUfgcuggsasc | 2269 | GUCCAGCACUUAACUCUAAUACA | 2403 |
| AD-519810.1 | csasgcacUfuAfAfCfucuaauacauL96 | 2136 | asUfsguaUfuAfGfaguuAfaGfugcugsgsa | 2270 | UCCAGCACUUAACUCUAAUACAU | 2404 |
| AD-519811.1 | asgscacuUfaAfCfUfcuaauacaucL96 | 2137 | asAfsuguAfuUfAfgaguUfaAfgugcusgsg | 2271 | CCAGCACUUAACUCUAAUACAUC | 2405 |
| AD-519814.1 | ascsuuaaCfucUfAfAfuacaucagcL96 | 2138 | asCfsugaUfgUfAfuuagAfgUfuaagusgsc | 2272 | GCACUUAACUCUAAUACAUCAGC | 2406 |
| AD-519820.1 | csusuaauAfcaUfCfAfUfcagcaugcguL96 | 2139 | asCfsgcaUfgCfUfgaugUfaUfuagagsusu | 2273 | AACUCUAAUACAUCAGCAUGCGU | 2407 |
| AD-519821.1 | uscsuaauAfcAfUfCfagcaugcguuL96 | 2140 | asAfscgcAfuGfCfugauUfgUfauuagsasu | 2274 | ACUCUAAUACAUCAGCAUGCGUU | 2408 |
| AD-519822.1 | csusuaauAfcAfUfCfagcaugcguuL96 | 2141 | asAfsacgCfaUfGfcugaUfgUfauuasgsag | 2275 | CUCUAAUACAUCAGCAUGCGUUA | 2409 |
| AD-519823.1 | usasauacAfuCfAfGfcaugcguuauL96 | 2142 | asUfsaacGfcAfUfgcugAfuGfuauuasgsa | 2276 | UCUAAUACAUCAGCAUGCGUUAU | 2410 |
| AD-519826.1 | usascaucAfgCfAfUfGfcguuaauuL96 | 2143 | asAfsauuAfaCfGfcaugCfuGfauguasusu | 2277 | AAUACAUCAGCAUGCGUUAAUUC | 2411 |
| AD-519827.1 | ascsaucaGfcAfUfGfCfguuauucuL96 | 2144 | asGfsaauUfaAfCfgcauGfcUfgaugusasu | 2278 | AUACAUCAGCAUGCGUUAAUUCA | 2412 |

TABLE 33-continued

Modified Sense and Antisense Strand Sequencesof PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-519828.3 | csasucagCfaUfGfCfguuaauucauL96 | 2145 | asUfsgaaUfuAfcgcaUfgCfugaugsusa | 2279 | UACAUCAGCAUGCGUUAUUCAG | 2413 |
| AD-519830.1 | uscsagcaUfgCfGfUfUfuaauucagcuL96 | 2146 | asGfscugAfaUfUfuaacgCfaUfgcugasusg | 2280 | CAUCAGCAUGCGUUAAUUCAGCU | 2414 |
| AD-519832.1 | asgscaugcUfgUfUfAfAfauucagcuguL96 | 2147 | asCfsagcUfgAfAfuuaaCfgCfaugcusgsa | 2281 | UCAGCAUGCGUUAAUUCAGCUGG | 2415 |
| AD-519887.1 | gsusccccuUfacUfUfGfacuguuucguL96 | 2148 | asCfsgaaAfcAfGfucagUfaAfgggacscsc | 2282 | GGGUCCCUUACUGACUGUUUCGU | 2416 |
| AD-519888.1 | uscscccuuAfcUfGfGfAfcuguuucgugL96 | 2149 | asAfscgaAfacUfAfgucaGfuAfaggascsc | 2283 | GGUCCCUUACUGACUGUUUCGUG | 2417 |
| AD-519889.1 | cscscuuacUfuGfAfCfuguuucgugguL96 | 2150 | asCfsacgAfaAfcUfagucAfgUfaagggsasc | 2284 | GUCCCUUACUGACUGUUUCGUGG | 2418 |
| AD-519890.1 | cscsuuacUfgAfCfUfguuucguggucL96 | 2151 | asCfscacGfaAfAfcaguCfaGfuaaggsgsa | 2285 | UCCCUUACUGACUGUUUCGUGGC | 2419 |
| AD-519929.1 | ususccagCfaUfGfAfgguucuuaguL96 | 2152 | asCfsuaaGfaAfCfcucaUfgCfuggaascsa | 2286 | UGUUCCAGCAUGAGGUUCUUAGA | 2420 |
| AD-519931.1 | cscsagcaUfgAfGfGfuucuuagaauL96 | 2153 | asUfsucuAfaGfAfAfccuCfaUfgcuggsasa | 2287 | UUCCAGCAUGAGGUUCUUAGAAU | 2421 |
| AD-519932.1 | csasgcauGfaGfGfUfucuuagaauuL96 | 2154 | asAfsuucUfaAfGfaacUfcAfugcugsgsa | 2288 | UCCAGCAUGAGGUUCUUAGAAUG | 2422 |
| AD-519933.1 | asgscaugAfgGfUfUfcuuagaaugucL96 | 2155 | asCfsauuCfuAfAfgaacCfuAfugcusgsg | 2289 | CCAGCAUGAGGUUCUUAGAAUGA | 2423 |
| AD-519935.2 | csasugagGfuUfCfUfUfaagaaugacaL96 | 2156 | asGfsucaUfuCfUfUfaagaAfcCfucaugscsu | 2290 | AGCAUGAGGUUCUUAGAAUGACA | 2424 |
| AD-519942.1 | ususucuuaGfaAfUfGfacaggguguL96 | 2157 | asAfsacaCfcUfGfUfucauUfCfUfaagaascsc | 2291 | GGUUCUUAGAAUGACAGGUGUUU | 2425 |
| AD-520005.1 | gsgsucugCfaAfAfGfaugauaaccuL96 | 2158 | asGfsguuAfuCfAfucuuUfgCfagaccsasc | 2292 | GUGGUCUGCAAAGAUGAUAACCU | 2426 |
| AD-520006.1 | gsusucugCfaAfAfGfAfugauaaccuuL96 | 2159 | asAfsgguUfaUfCfaucuUfuGfcagacscsa | 2293 | UGGUCUGCAAAGAUGAUAACCUU | 2427 |
| AD-520007.1 | uscsugcaAfaGfAfUfgauaaccuugL96 | 2160 | asAfsaggUfuAfUfcaucUfuUfgcagascsc | 2294 | GGUCUGCAAAGAUGAUAACCUUG | 2428 |
| AD-520008.1 | csusugcaAfagAfUfgAfUfaaccuugacL96 | 2161 | asCfsaagGfuUfAfuucaucUfuUfugcagsasc | 2295 | GUCUGCAAAGAUGAUAACCUUGA | 2429 |
| AD-520011.1 | csasaagaUfgAfUfAfAfccuugacuaL96 | 2162 | asAfsgucAfaGfGfuuauCfaUfcuuugscsa | 2296 | UGCAAAGAUGAUAACCUUGACUA | 2430 |
| AD-520020.1 | usasaaccUfgAfcUfAfcuaaaaacgL96 | 2163 | asGfsuuuUfuAfGfuaguCfaAfgguuasusc | 2297 | GAUAACCUUGACUACUAAAAACG | 2431 |
| AD-520021.1 | asasccuugAfcUfUfAfcuaaaaacguL96 | 2164 | asCfsguuUfuUfAfguagUfcAfagguuasusu | 2298 | AUAACCUUGACUACUAAAAACGU | 2432 |
| AD-520022.1 | ascsccuugAfcUfAfcUfuaaaaacguuL96 | 2165 | asAfscguUfuUfUfaguaGfuCfaaggususa | 2299 | UAACCUUGACUACUAAAAACGUC | 2433 |
| AD-520023.1 | cscsuugaCfUfAfCfUfaaaaacguuL96 | 2166 | asAfsacgUfUfUfUfuaguAfgUfcaaggusu | 2300 | AACCUUGACUACUAAAAACGUCU | 2434 |
| AD-520024.1 | csusugacUfaCfUfAfaaaacgucuuL96 | 2167 | asAfsgacGfuUfUfUfuagUfaGfucaagsgsu | 2301 | ACCUUGACUACUAAAAACGUCUC | 2435 |
| AD-520025.1 | ususugacUfaCfUfAfAfaaacgucucuL96 | 2168 | asGfsagaCfgUfUfUfuuaaGftuAfgucaagsgsg | 2302 | CCUUGACUACUAAAAACGUCUCC | 2436 |

TABLE 33-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-520034.1 | gsgsguaaCfaAfgGfAfAfugauaaucuuL96 | 2169 | aaAfsgauUfcFfaucuUfgUfuacccscsc | 2303 | GGGGUAACAAGAUGAUAAUCUA | 2437 |
| AD-520035.3 | gsgsuaacAfaGfAfGfAfAfugauaaucuacuL96 | 2170 | asUfsagaUfuAfUfcaucUfuGfuuaccscsc | 2304 | GGGUAACAAGAUGAUAAUCUAC | 2438 |
| AD-520036.1 | gsusuacaAfgAfUfGfAfauaaucuacuCfuL96 | 2171 | asGfsuagaAfuUfAfucauCfuUfguuacscsc | 2305 | GGUAACAAGAUGAUAAUCUACU | 2439 |
| AD-520037.1 | usasacaaGfaUfGfAfAfuaaucuacuuL96 | 2172 | asAfsguaGfaUfUfaucaUfcUfuguuascsc | 2306 | GGUAACAAGAUGAUAAUCUACUU | 2440 |
| AD-520038.1 | asasacaagAfuGfAfUfAfaucuacuuuL96 | 2173 | asAfsaguAfuGfAfUfuaucAfuCfuuguuasasc | 2307 | GUAACAAGAUGAUAAUCUACUUA | 2441 |
| AD-520053.1 | ususuuagAfaCfAfCfcuuuuucacuL96 | 2174 | asGfsugaAfaAfAfgguggUfuCfuaaasusu | 2308 | AAUUUAGAACACCUUUUUCACC | 2442 |
| AD-520060.3 | ascsaccuUfuUfUfCfcaccuaacuaaaL96 | 2175 | asUfsaguUfaGfGfguagAfaAfaggugsusu | 2309 | GAACACCUUUUCACCUAACUAA | 2443 |
| AD-520061.3 | csasccuuUfuCfAfCfcuaacuaaaUfaL96 | 2176 | asUfsuagUfuAfGfguagAfaAfagguguusu | 2310 | AACACCUUUUCACCUAACUAAA | 2444 |
| AD-520064.5 | csuuuuucCfaCfCfUfAfacuaacuaaaauuL96 | 2177 | asAfsuuuUfaGfUfuaggUfgAfaaaagsgsu | 2311 | CCUUUUCACCUAACUAAAAUAA | 2445 |
| AD-520065.4 | ususuuucAfcCfUfAfAfacuaaaauuL96 | 2178 | asUfsauuUfuUfAfguuaGfgUfgaaaasgsu | 2312 | CUUUUCACCUAACUAAAAUAAA | 2446 |
| AD-520066.2 | ususuucaCfcUfAfAfcuaaaauauauL96 | 2179 | asUfsauaUfuUfUfaguuAfgGfugaasasa | 2313 | UUUUCACCUAACUAAAAUAAAU | 2447 |
| AD-520067.3 | ususcaccUfaAfCfUfAfaaaauauauL96 | 2180 | asAfsuauAfuUfUfuuagUfuAfggugasasa | 2314 | UUUCACCUAACUAAAAUAAAUG | 2448 |
| AD-520068.3 | uscsaccuAfaCfUfAfAfaauaaugLuuL96 | 2181 | asCfsauuAfuUfUfuuuaGfuUfagguasasa | 2315 | UUCACCUAACUAAAAUAAAUGUU | 2449 |
| AD-520069.3 | csasccuaAfcUfAfAfAfaauaaugunuL96 | 2182 | asAfsacaUfuAfUfuuuaGfuUfaggugsasa | 2316 | UCACCUAACUAAAAUAAAUGUU | 2450 |
| AD-520087.1 | asusguaaGfaAfGfcgGfuguuacuL96 | 2183 | asGfsuaaCfaAfCfgcuuCfcUfuacaususu | 2317 | AAAUGUAAGGAAGCGUUGUUACC | 2451 |
| AD-520095.1 | asasgcguUfgAfUfAfCfcuguugaauL96 | 2184 | asUfsucaAfcAfGfGfuaaCfaAfcgcuuscsc | 2318 | GGAAGCGUUGUUACCUGUUGAAU | 2452 |
| AD-520096.1 | asgsgguuGfuUfAfCfcuguugaauuL96 | 2185 | asUfsuucAfcAfGfguaaCfaAfcacgcusuc | 2319 | GAAGCGUUGUUACCUGUUGAAUU | 2453 |
| AD-520098.2 | gsusuguuAfcCfUfGfUfugaauuuuuL96 | 2186 | asAfsaaaAfuUfCfaacagGfuAfacaacsgsc | 2320 | GCGUGUUACCUGUUGAAUUUG | 2454 |
| AD-75256.2 | ususguuaCfcUfGfUfUfgaauuuguL96 | 2187 | asCfsaaaAfuUfCfaacaGfuAfacaascsg | 2321 | CGUGUUACCUGUUGAAUUUGU | 2455 |
| AD-520099.3 | usgsuuacCfuGfUfUfgaauuuguaL96 | 2188 | asAfscaaAfuUfCfaacAfGfGfuaacsa | 2322 | GUUGUUACCUGUUGAAUUUGUA | 2456 |
| AD-67575.8 | usuacaccUfgUfUfgAfAfuucaaguguaL96 | 2189 | asAfsuacAfaUfUfcaaCfAfgGfuaascsa | 2323 | UGUUACCUGUUGAAUUUGUA | 2457 |
| AD-520101.3 | usasccugUfuGfAfAfuuuguauuL96 | 2190 | asAfsauaCfaAfAfuucAfaCfagguuasasc | 2324 | UGUUACCUGUUGAAUUUGUA | 2458 |
| AD-67605.8 | ascscuguUfgAfAfUfufguauuaufL96 | 2191 | asUfsaauUfaCfAfaauuCfaAfcaggsusa | 2325 | GUUACCUGUUGAAUUUGUAUU | 2459 |
| AD-520102.1 | csusguugAfaUfUfUfguauauguL96 | 2192 | asCfsauaAfuAfCfaaauUfcAfaacagsgsu | 2326 | UUACCUGUUGAAUUUGUAUAU | 2460 |
| | | 2193 | | 2327 | ACCUGUUGAAUUUGUAUAUGU | 2461 |

TABLE 33-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-520103.1 | gsusugaaUfuUfGfGfuauuaugugcuL96 | 2194 | asCfsacaUfaAfUfacaaAfaUfuccaacsasg | 2328 | CUGUUGAAUUUUGUAUUAUGUGA | 2462 |
| AD-520123.1 | csasgugaUfaUfGfGfUfuaguagaauuL96 | 2195 | asAfsuucUfaCfUfaacaUfcUfcacugsasu | 2329 | AUCAGUGAGAUGUUAGUAGAAUA | 2463 |
| AD-520127.1 | gsasgaugUfuAfGfUfagaauaagcuL96 | 2196 | asGfscuuAfuUfCfuacuAfaCfaaucucsasc | 2330 | GUGAGAUGUUAGUAGAAUAAGCC | 2464 |
| AD-520133.1 | usasguagAfuUfAfAfgccuuaaaauL96 | 2197 | asUfsuuuAfaGfGfcuuaUfuCfuacuasasc | 2331 | GUUAGUAGAAUAAGCCUUAAAAA | 2465 |
| AD-520350.1 | gscsugagAfuUfGfCfaccauucauL96 | 2198 | asUfsgaaAfuGfGfugcaAfuCfucagcsusc | 2332 | GAGCUGAGAUUGCACCAUUUCAU | 2466 |
| AD-520351.1 | csusgagaUfuGfCfAfccauuucauuL96 | 2199 | asAfsugaAfuGfGfugcAfaUfcucagscsu | 2333 | AGCUGAGAUUGCACCAUUUCAUU | 2467 |
| AD-520352.2 | usgsagauUfgCfAfCfcauuucauuL96 | 2200 | asAfsaugAfaAfUfgguAfaUfucucacsgsc | 2334 | GCUGAGAUUGCACCAUUUCAUUC | 2468 |
| AD-520354.1 | asgsauugCfaCfCfAfuuucauucuL96 | 2201 | asGfsgaaUfgAfAfauggUfgCfaaucuscsa | 2335 | UGAGAUUGCACCAUUUCAUUCCA | 2469 |
| AD-520391.1 | asascaaaAfaUfAfAfucuaguugucL96 | 2202 | asGfscacAfcUfAfgauuAfuUfuuguususu | 2336 | AAAACAAAAUAAUCUAGUGUGCA | 2470 |
| AD-520393.1 | csasaaauAfaUfCfUfagugugcagL96 | 2203 | asCfsugcAfcAfCfuagaUfuAfuuuugsusu | 2337 | AACAAAAUAAUCUAGUGUGCAGG | 2471 |
| AD-520467.2 | ususgaacCfuGfGfCfuuauuucuuL96 | 2204 | asAfsgaaAfaUfAfagccAfgGfuccaasgsu | 2338 | ACUUGAACCUGGCUUAUUUUCUG | 2472 |
| AD-520481.1 | csascaugGfuCfAfGfugaguuucuuL96 | 2205 | asAfsgaaAfcUfCfacugAfcCfaugugsgsg | 2339 | CCCACAUGGUCAGUGAGUUUCUC | 2473 |

TABLE 34

PNPLA3 Single Dose Screen in Hep3B Cells

| | 50 nM | | 10 nM | | 1 nM | | 0.1 nM | |
|---|---|---|---|---|---|---|---|---|
| Duplex | Avg | SD | Avg | SD | Avg | SD | Avg | SD |
| AD-518658.1 | 42.94766 | 12.41792 | 64.82536 | 23.85209 | 100.7428 | 19.40937 | 93.04989 | 10.43198 |
| AD-518707.1 | 55.62284 | 10.27535 | 71.93996 | 7.142065 | 105.6231 | 6.809517 | 101.7458 | 24.26104 |
| AD-518708.1 | 69.75236 | 17.4307 | 65.43961 | 13.43465 | 116.9685 | 10.62334 | 108.8084 | 20.02657 |
| AD-518709.1 | 50.31404 | 5.652726 | 47.3224 | 5.147422 | 84.40248 | 16.07951 | 103.3354 | 20.86118 |
| AD-518722.1 | 69.92801 | 9.598491 | 50.6688 | 17.8235 | 95.22432 | 19.21756 | 96.11806 | 12.44369 |
| AD-518789.1 | 32.53758 | 5.593675 | 32.77075 | 4.054891 | 50.71233 | 7.306018 | 65.33746 | 3.716173 |
| AD-518791.1 | 33.37483 | 4.059424 | 42.05998 | 3.447412 | 84.64916 | 8.215959 | 78.26863 | 11.97385 |
| AD-518792.1 | 43.20357 | 13.54477 | 55.52443 | 3.322024 | 87.85942 | 9.678187 | 75.64313 | 15.3978 |
| AD-518794.1 | 48.32774 | 13.80689 | 73.9973 | 15.10836 | 95.08435 | 15.93579 | 94.333 | 19.92082 |
| AD-518800.1 | 69.62243 | 3.754956 | 78.00498 | 8.905591 | 126.5248 | 12.07819 | 87.10116 | 4.495733 |
| AD-518827.1 | 66.84976 | 1.87091 | 64.05565 | 7.824748 | 109.3026 | 15.19898 | 122.0295 | 26.52146 |
| AD-518829.1 | 95.0517 | 11.75578 | 91.47261 | 5.656564 | 127.3295 | 25.96408 | 123.1953 | 22.12334 |
| AD-518831.2 | 54.44406 | 8.796633 | 55.56703 | 8.592537 | 75.10855 | 12.05533 | 94.42534 | 11.73385 |
| AD-518832.2 | 72.24416 | 13.66241 | 62.79827 | 10.55016 | 88.30892 | 15.80649 | 99.79269 | 13.66623 |
| AD-518857.1 | 47.26442 | 8.72365 | 39.35137 | 6.083911 | 68.1639 | 8.1472 | 85.29716 | 11.93514 |
| AD-518921.1 | 67.47179 | 23.73035 | 66.31535 | 9.437307 | 96.34766 | 15.71656 | 71.63637 | 13.82891 |
| AD-518922.2 | 42.15927 | 11.13492 | 54.55048 | 17.92362 | 86.58956 | 13.01162 | 98.89853 | 6.354892 |
| AD-518923.2 | 41.7079 | 3.949238 | 46.7206 | 9.026298 | 58.04384 | 5.899113 | 70.61148 | 5.844163 |
| AD-518924.2 | 59.32409 | 12.35522 | 66.42772 | 17.2608 | 93.49551 | 4.358715 | 101.9138 | 20.19513 |
| AD-518925.2 | 80.49793 | 11.48081 | 79.82113 | 8.071919 | 85.65246 | 9.87835 | 107.6037 | 11.50751 |
| AD-518967.1 | 65.01747 | 7.983442 | 60.89236 | 9.690421 | 68.56459 | 5.707428 | 96.17366 | 15.85213 |
| AD-518968.1 | 61.42989 | 4.832082 | 63.15834 | 7.35798 | 71.61803 | 10.4465 | 102.5449 | 13.47582 |
| AD-518976.1 | 86.43122 | 10.59274 | 99.15413 | 17.861639 | 106.5852 | 27.62984 | 94.79483 | 4.2749 |
| AD-518977.1 | 97.00068 | 21.92919 | 78.96241 | 17.53663 | 92.04531 | 9.774873 | 76.36653 | 9.779583 |
| AD-518978.1 | 52.37278 | 11.64162 | 93.20182 | 8.322116 | 108.6372 | 2.25339 | 105.309 | 14.97478 |
| AD-518979.1 | 66.15803 | 16.38301 | 83.53397 | 26.14738 | 115.7627 | 17.24141 | 91.00506 | 20.14569 |
| AD-518980.2 | 102.8949 | 13.60259 | 114.919 | 22.75057 | 101.7028 | 16.93855 | 137.2896 | 13.75517 |
| AD-519043.1 | 52.27022 | 1.565815 | 65.30566 | 6.985576 | 99.69383 | 10.65792 | 118.6239 | 13.86267 |
| AD-519340.1 | 50.02449 | 3.164387 | 59.53594 | 7.087385 | 83.13269 | 17.55595 | 104.4721 | 8.587117 |
| AD-519341.1 | 56.5467 | 4.790482 | 71.17177 | 4.959802 | 89.62357 | 8.905254 | 106.1918 | 6.972196 |
| AD-519342.1 | 40.34185 | 2.272544 | 51.3861 | 5.876967 | 80.09125 | 14.52679 | 95.36078 | 12.45925 |
| AD-519343.1 | 25.54698 | 3.00203 | 27.78009 | 9.325246 | 44.82058 | 9.65901 | 84.70717 | 12.42313 |
| AD-519344.1 | 30.81974 | 6.324083 | 42.91242 | 10.1455 | 63.99386 | 13.26317 | 70.11595 | 5.616455 |
| AD-519349.1 | 25.64301 | 4.685127 | 35.13943 | 10.39843 | 49.6449 | 7.724092 | 63.0249 | 16.56877 |
| AD-519350.1 | 25.37437 | 5.106213 | 33.42453 | 7.475218 | 48.36196 | 8.196347 | 77.78587 | 9.513747 |
| AD-519477.1 | 55.15233 | 1.53307 | 58.82498 | 1.176072 | 86.54209 | 11.23175 | 129.8929 | 22.37189 |
| AD-519596.1 | 49.32799 | 7.794994 | 66.34927 | 8.449974 | 85.59407 | 10.75557 | 122.6109 | 21.977 |
| AD-519622.1 | 72.31278 | 7.77303 | 83.80396 | 3.236319 | 89.72191 | 20.42891 | 101.6253 | 16.2137 |
| AD-519666.1 | 58.99223 | 9.174687 | 60.92266 | 2.279997 | 62.24535 | 8.846176 | 84.60831 | 9.404301 |
| AD-519667.1 | 39.03083 | 10.13723 | 32.13225 | 3.182724 | 54.28087 | 9.091912 | 63.60743 | 16.76734 |
| AD-519668.1 | 39.28227 | 7.783368 | 52.52746 | 15.97764 | 90.38161 | 8.507587 | 83.20261 | 10.42693 |
| AD-519669.1 | 56.79735 | 2.773505 | 62.00964 | 8.54995 | 91.87774 | 16.31173 | 102.7233 | 30.30425 |
| AD-519670.1 | 63.18069 | 13.12076 | 66.46455 | 5.746918 | 74.18941 | 25.33623 | 115.1692 | 6.864002 |
| AD-519671.1 | 62.08825 | 6.619747 | 77.23297 | 14.70727 | 76.38787 | 12.4203 | 107.8572 | 12.53719 |
| AD-519672.1 | 74.15201 | 10.12734 | 91.90442 | 7.785918 | 94.94023 | 10.03551 | 117.9209 | 5.07782 |
| AD-519691.1 | 45.7187 | 10.19413 | 61.86656 | 16.24762 | 81.99914 | 12.03996 | 85.72808 | 10.46489 |
| AD-519692.1 | 69.49335 | 11.27899 | 75.27569 | 10.25374 | 110.613 | 15.88181 | 105.2715 | 10.10224 |
| AD-519693.1 | 54.32562 | 9.364318 | 65.18126 | 12.43703 | 77.75208 | 7.341201 | 114.9356 | 19.24612 |
| AD-519694.1 | 56.31428 | 7.487224 | 63.04836 | 4.47575 | 79.4272 | 19.21656 | 105.4726 | 30.78601 |
| AD-519696.1 | 80.14073 | 4.963576 | 90.4529 | 7.234866 | 106.7291 | 12.33685 | 116.2394 | 17.5721 |
| AD-67554.6 | 32.5344 | 2.785433 | 41.83857 | 6.041739 | 39.86673 | 4.460883 | 75.97448 | 27.32283 |
| AD-519752.2 | 43.34072 | 3.127806 | 51.03679 | 8.917442 | 46.87752 | 5.764831 | 80.92584 | 12.17422 |
| AD-519753.2 | 25.96199 | 5.067472 | 37.45149 | 3.147941 | 48.76312 | 12.1361 | 55.46163 | 9.983352 |
| AD-519754.8 | 50.72996 | 13.31669 | 61.07876 | 5.56202 | 89.88631 | 16.05322 | 109.8062 | 23.17114 |
| AD-519755.4 | 51.58956 | 5.473844 | 52.51098 | 4.438733 | 63.18747 | 6.566833 | 81.27018 | 14.70514 |
| AD-519759.2 | 63.65028 | 3.967476 | 73.12785 | 11.96064 | 102.2376 | 7.185976 | 116.2375 | 25.02045 |
| AD-519760.2 | 62.00693 | 15.41249 | 51.28109 | 5.820685 | 69.81737 | 16.40661 | 82.37727 | 14.72109 |
| AD-519761.2 | 53.73688 | 3.887523 | 57.02822 | 9.22889 | 64.59723 | 7.706789 | 105.7042 | 11.06913 |
| AD-519766.2 | 50.21221 | 9.519207 | 66.10495 | 5.487173 | 88.64545 | 15.71198 | 106.0675 | 7.998775 |
| AD-519773.1 | 29.88908 | 3.299812 | 34.55844 | 5.789048 | 44.35859 | 3.297106 | 75.38487 | 19.86745 |
| AD-519776.1 | 33.56361 | 9.147108 | 44.87364 | 11.43685 | 62.63161 | 7.745073 | 75.53641 | 27.11615 |
| AD-519777.1 | 58.78548 | 20.27898 | 72.5594 | 11.24378 | 106.9036 | 12.15886 | 121.0682 | 15.67886 |
| AD-519779.1 | 60.65973 | 4.346633 | 68.90639 | 5.485959 | 96.38133 | 14.77649 | 99.24701 | 11.64262 |
| AD-519809.1 | 51.34968 | 4.70846 | 62.59669 | 11.5038 | 85.99883 | 10.76169 | 117.9819 | 28.94899 |
| AD-519810.1 | 52.77966 | 4.812098 | 58.85969 | 11.53462 | 75.04217 | 15.48752 | 96.04315 | 9.024712 |
| AD-519811.1 | 41.83074 | 5.570013 | 62.54468 | 6.636095 | 68.85843 | 4.515473 | 96.25603 | 13.47886 |
| AD-519814.1 | 43.6037 | 4.666228 | 51.40583 | 5.184036 | 70.30465 | 6.649075 | 112.0615 | 7.600643 |
| AD-519820.1 | 35.46836 | 5.787243 | 44.97954 | 3.359216 | 75.81738 | 12.67708 | 83.99358 | 7.381867 |
| AD-519821.1 | 30.70277 | 3.62287 | 39.00705 | 5.193448 | 71.72964 | 5.90817 | 52.42374 | 2.717107 |
| AD-519822.1 | 24.09065 | 3.392701 | 42.99502 | 11.23734 | 79.03643 | 19.71305 | 101.1889 | 15.16909 |
| AD-519823.1 | 53.12406 | 7.898687 | 54.03719 | 10.43083 | 85.09653 | 22.19466 | 101.8818 | 16.35143 |
| AD-519826.1 | 42.85731 | 2.286875 | 51.97531 | 10.79151 | 81.25133 | 8.59057 | 104.7209 | 9.680307 |
| AD-519827.1 | 79.38389 | 3.13229 | 88.43322 | 15.29789 | 103.171 | 8.051649 | 97.46346 | 10.30878 |
| AD-519828.3 | 37.66239 | 5.17373 | 52.17304 | 6.709216 | 64.23609 | 3.999677 | 99.78564 | 16.62182 |

TABLE 34-continued

PNPLA3 Single Dose Screen in Hep3B Cells

| Duplex | 50 nM Avg | SD | 10 nM Avg | SD | 1 nM Avg | SD | 0.1 nM Avg | SD |
|---|---|---|---|---|---|---|---|---|
| AD-519830.1 | 47.12815 | 8.031646 | 59.14945 | 9.487784 | 82.00889 | 18.98362 | 89.30526 | 6.13986 |
| AD-519832.1 | 34.91341 | 4.749048 | 55.74108 | 3.769992 | 71.52871 | 4.738435 | 89.7728 | 8.801833 |
| AD-519887.1 | 32.15966 | 9.58332 | 43.38057 | 8.765226 | 60.82413 | 30.07213 | 72.79899 | 10.84883 |
| AD-519888.1 | 54.53395 | 11.20725 | 71.71064 | 13.2849 | 120.5159 | 24.54163 | 105.1235 | 2.614384 |
| AD-519889.1 | 57.80795 | 12.25515 | 66.40043 | 6.480154 | 114.7472 | 10.06082 | 111.2871 | 10.37692 |
| AD-519890.1 | 71.77843 | 5.504303 | 89.06564 | 9.311918 | 114.8869 | 22.11956 | 122.6381 | 21.95622 |
| AD-519929.1 | 51.24411 | 4.482367 | 57.14287 | 10.9567 | 83.69919 | 13.52289 | 93.01579 | 7.833971 |
| AD-519931.1 | 50.30644 | 3.56686 | 62.02151 | 3.375044 | 83.31024 | 5.457631 | 102.6883 | 5.397906 |
| AD-519932.1 | 31.44614 | 11.99819 | 45.59588 | 11.73238 | 67.6784 | 21.54268 | 102.4539 | 36.79452 |
| AD-519933.1 | 32.84923 | 3.175817 | 50.03872 | 9.146825 | 72.2142 | 5.834927 | 69.56286 | 13.82901 |
| AD-519935.2 | 23.19916 | 5.459604 | 34.57125 | 4.267756 | 52.33182 | 7.461964 | 52.51531 | 2.774906 |
| AD-519942.1 | 33.43069 | 7.462724 | 53.47246 | 9.257367 | 90.53541 | 13.39055 | 99.71394 | 8.678145 |
| AD-520005.1 | 54.87907 | 8.873501 | 72.14087 | 12.56384 | 111.6164 | 14.67787 | 106.2691 | 14.61877 |
| AD-520006.1 | 24.04719 | 2.376527 | 39.32581 | 3.470195 | 76.83414 | 16.33539 | 98.31059 | 15.6044 |
| AD-520007.1 | 16.0072 | 2.896706 | 28.52854 | 4.013988 | 56.35011 | 5.720959 | 71.24665 | 3.904088 |
| AD-520008.1 | 70.54243 | 7.357645 | 61.40247 | 10.0634 | 76.12696 | 10.8282 | 81.73514 | 12.70165 |
| AD-520011.1 | 61.34677 | 18.83765 | 55.76087 | 8.165514 | 81.57725 | 16.00681 | 75.3319 | 5.415098 |
| AD-520020.1 | 56.73076 | 8.466195 | 53.84936 | 9.58588 | 85.81525 | 20.35519 | 70.27459 | 15.07749 |
| AD-520021.1 | 58.05942 | 7.510224 | 49.3573 | 6.039504 | 82.04944 | 15.89054 | 85.39012 | 20.28745 |
| AD-520022.1 | 60.33364 | 4.301973 | 45.63061 | 6.280662 | 81.19155 | 15.95622 | 85.09768 | 18.42796 |
| AD-520023.1 | 53.1275 | 5.840407 | 51.07057 | 10.97167 | 82.54809 | 4.396742 | 80.65711 | 10.21667 |
| AD-520024.1 | 37.0917 | 8.452936 | 38.18884 | 6.75889 | 59.22727 | 13.7917 | 66.24876 | 10.41801 |
| AD-520025.1 | 36.99918 | 5.011139 | 41.66326 | 4.435679 | 55.22974 | 9.676515 | 61.5233 | 10.29043 |
| AD-520034.1 | 50.74447 | 16.90927 | 55.13512 | 15.82911 | 69.34809 | 9.6233 | 68.24787 | 8.182789 |
| AD-520035.3 | 47.68497 | 13.2744 | 41.72851 | 3.402547 | 79.78654 | 18.57665 | 66.67162 | 8.660544 |
| AD-520036.1 | 62.46816 | 8.270828 | 50.74637 | 8.326201 | 76.46313 | 11.95967 | 92.93795 | 9.492514 |
| AD-520037.1 | 56.5259 | 8.816028 | 50.21156 | 9.119045 | 81.8312 | 14.2877 | 85.90267 | 13.16231 |
| AD-520038.1 | 51.75385 | 18.57013 | 34.06313 | 8.261207 | 56.86823 | 7.901725 | 81.77106 | 3.523512 |
| AD-520053.1 | 41.77559 | 8.867003 | 41.62096 | 19.77457 | 63.14894 | 8.57688 | 65.0597 | 2.993574 |
| AD-520060.3 | 44.68219 | 8.424713 | 37.26257 | 7.035423 | 59.53055 | 7.908942 | 79.85002 | 27.59914 |
| AD-520061.3 | 28.67808 | 4.381034 | 33.96453 | 1.79867 | 65.35527 | 12.69704 | 52.54273 | 8.841387 |
| AD-520064.5 | 48.04944 | 8.872461 | 44.13648 | 11.70039 | 71.24889 | 12.89441 | 83.53806 | 16.61364 |
| AD-520065.4 | 66.23067 | 11.50931 | 54.42123 | 9.981868 | 65.499 | 6.582631 | 95.33679 | 24.57588 |
| AD-520066.2 | 95.65312 | 47.68023 | 67.23665 | 3.849851 | 79.22817 | 13.4242 | 92.7217 | 32.33753 |
| AD-520067.3 | 105.1375 | 37.57514 | 43.67235 | 7.126124 | 52.75892 | 4.102313 | 101.1133 | 15.14941 |
| AD-75289.4 | 56.22618 | 10.19969 | 62.18789 | 16.47643 | 68.09052 | 3.20629 | 96.80374 | 10.91438 |
| AD-520068.3 | 70.91495 | 2.704445 | 53.84268 | 7.744443 | 78.77375 | 10.06 | 93.78921 | 4.586384 |
| AD-520069.3 | 39.78116 | 11.92992 | 49.98416 | 7.246082 | 73.49029 | 10.7709 | 72.88815 | 20.82402 |
| AD-520087.1 | 68.98191 | 8.459896 | 76.07173 | 15.31797 | 104.4457 | 13.22462 | 113.8743 | 43.9017 |
| AD-520095.1 | 81.69757 | 9.807112 | 82.56076 | 31.28487 | 96.63698 | 22.73994 | 86.29611 | 9.239682 |
| AD-520096.1 | 64.90297 | 1.936481 | 73.68988 | 26.59006 | 77.92236 | 9.635013 | 96.03301 | 15.61368 |
| AD-520098.2 | 112.056 | 49.26435 | 72.75627 | 13.56107 | 71.41998 | 14.01052 | 71.59986 | 6.379803 |
| AD-75256.2 | 75.79616 | 8.737346 | 74.33521 | 23.01815 | 85.34296 | 16.72191 | 98.87664 | 15.70082 |
| AD-520099.3 | 59.03481 | 13.43313 | 48.04655 | 4.361352 | 65.41177 | 10.4964 | 106.4857 | 12.07129 |
| AD-67575.8 | 35.92082 | 6.119518 | 52.70581 | 10.20549 | 62.67975 | 14.50294 | 70.73624 | 4.135402 |
| AD-520101.3 | 58.99073 | 10.67199 | 73.28896 | 30.81621 | 93.80172 | 7.608287 | 92.6562 | 21.29585 |
| AD-67605.8 | 59.32836 | 23.51253 | 62.08382 | 10.45108 | 90.11555 | 23.85401 | 81.39889 | 14.06351 |
| AD-520102.1 | 75.87013 | 7.619236 | 96.86606 | 25.47729 | 86.92724 | 3.927143 | 93.45379 | 4.342059 |
| AD-520103.1 | 82.82953 | 7.726372 | 89.38753 | 17.13548 | 98.84202 | 10.39095 | 97.07032 | 15.12284 |
| AD-520123.1 | 102.8972 | 19.3969 | 74.9593 | 9.436158 | 77.04401 | 6.792248 | 92.67994 | 8.25485 |
| AD-520127.1 | 73.10119 | 23.1491 | 97.15216 | 30.89856 | 91.29938 | 7.718378 | 105.2282 | 19.25022 |
| AD-520133.1 | 36.1541 | 6.391883 | 67.15863 | 24.0854 | 62.06326 | 14.57401 | 69.3185 | 9.301314 |
| AD-520350.1 | 58.87999 | 14.59136 | 90.84397 | 18.68087 | 80.50092 | 1.862191 | 82.76945 | 25.04629 |
| AD-520351.1 | 71.26303 | 7.088025 | 76.54699 | 6.320899 | 137.9383 | 34.59137 | 97.85447 | 11.56826 |
| AD-520352.2 | 85.42707 | 13.84644 | 90.42389 | 8.580908 | 107.6216 | 16.56475 | 107.883 | 10.17883 |
| AD-520354.1 | 95.72204 | 19.82589 | 76.68991 | 4.160213 | 82.13668 | 14.73163 | 129.7049 | 24.2914 |
| AD-520391.1 | 129.611 | 19.84147 | 123.2649 | 30.64217 | 84.44844 | 16.43249 | 104.8518 | 6.691812 |
| AD-520393.1 | 102.3696 | 22.0114 | 108.367 | 33.90646 | 82.13201 | 9.440079 | 108.4258 | 13.13794 |
| AD-520467.2 | 57.00049 | 5.905218 | 65.50329 | 11.03502 | 58.17843 | 10.07205 | 93.36498 | 19.27898 |
| AD-520481.1 | 69.55206 | 1.607017 | 75.37835 | 8.657669 | 70.73405 | 11.67826 | 98.46396 | 27.39758 |

TABLE 35

PNPLA3 Single Dose Screen in Primary Cynomolgus Hepatocytes (PCH)

| Duplex | 50 nM Avg | SD | 10 nM Avg | SD | 1 nM Avg | SD | 0.1 nM Avg | SD |
|---|---|---|---|---|---|---|---|---|
| AD-518658.1 | 42.94766 | 12.41792 | 107.2499 | 25.92054 | 108.4212 | 13.09521 | 111.2395 | 18.49003 |
| AD-518707.1 | 55.62284 | 10.27535 | 65.31688 | 10.74275 | 87.51894 | 4.680768 | 97.55652 | 8.789667 |

TABLE 35-continued

PNPLA3 Single Dose Screen in Primary Cynomolgus Hepatocytes (PCH)

| | 50 nM | | 10 nM | | 1 nM | | 0.1 nM | |
|---|---|---|---|---|---|---|---|---|
| Duplex | Avg | SD | Avg | SD | Avg | SD | Avg | SD |
| AD-518708.1 | 69.75236 | 17.4307 | 82.07462 | 7.024724 | 101.0641 | 5.648431 | 102.4511 | 6.754587 |
| AD-518709.1 | 50.31404 | 5.652726 | 31.56035 | 2.229946 | 53.01344 | 6.566759 | 90.32525 | 6.88911 |
| AD-518722.1 | 69.92801 | 9.598491 | 73.56284 | 23.22718 | 87.72646 | 10.60739 | 99.94279 | 0.399497 |
| AD-518789.1 | 32.53758 | 5.593675 | 99.3493 | 5.934069 | 108.6534 | 5.010722 | 102.1127 | 7.124654 |
| AD-518791.1 | 33.37483 | 4.059424 | 108.3646 | 7.1364 | 106.7647 | 10.988 | 104.953 | 9.843194 |
| AD-518792.1 | 43.20357 | 13.54477 | 102.7673 | 4.006107 | 113.5466 | 19.39515 | 98.04121 | 5.026568 |
| AD-518794.1 | 48.32774 | 13.80689 | 111.6904 | 1.606519 | 95.31782 | 12.7478 | 119.9721 | 18.7764 |
| AD-518800.1 | 69.62243 | 3.754956 | 102.9294 | 3.404207 | 100.6042 | 1.31281 | 105.7795 | 4.662372 |
| AD-518827.1 | 66.84976 | 1.87091 | 43.72212 | 6.04683 | 62.32772 | 5.541399 | 89.35777 | 1.566393 |
| AD-518829.1 | 95.0517 | 11.75578 | 46.53891 | 4.776352 | 92.57407 | 12.66442 | 97.58275 | 6.311261 |
| AD-518831.2 | 54.44406 | 8.796633 | 33.53257 | 6.622253 | 48.34299 | 3.453772 | 77.46457 | 4.24481 |
| AD-518832.2 | 72.24416 | 13.66241 | 44.97781 | 8.475713 | 76.43563 | 14.96934 | 94.37157 | 4.830518 |
| AD-518857.1 | 47.26442 | 8.72365 | 25.91835 | 5.262805 | 30.45906 | 3.310539 | 50.39355 | 2.457611 |
| AD-518921.2 | 67.47179 | 23.73035 | 38.22451 | 2.010726 | 84.3703 | 3.972883 | 111.7785 | 8.371431 |
| AD-518922.2 | 42.15927 | 11.13492 | 25.87297 | 4.283199 | 35.38645 | 8.004708 | 65.68091 | 2.858227 |
| AD-518923.2 | 41.7079 | 3.949238 | 18.61375 | 2.565515 | 27.95204 | 7.348621 | 45.49059 | 5.685225 |
| AD-518924.2 | 59.32409 | 12.35522 | 27.651 | 2.401131 | 50.48284 | 5.945514 | 93.43941 | 8.653832 |
| AD-518925.2 | 80.49793 | 11.48081 | 63.69099 | 8.749987 | 89.37984 | 5.319914 | 108.7819 | 17.40859 |
| AD-518967.1 | 65.01747 | 7.983442 | 28.57555 | 2.488417 | 45.79731 | 11.52997 | 79.26503 | 14.64462 |
| AD-518968.1 | 61.42989 | 4.832082 | 64.48533 | 11.41152 | 58.35085 | 12.27641 | 79.24612 | 4.769727 |
| AD-518976.1 | 86.43122 | 10.59274 | 104.7096 | 7.723962 | 117.0872 | 10.04325 | 104.5054 | 11.24525 |
| AD-518977.1 | 97.00068 | 21.92919 | 102.0546 | 8.089759 | 112.7422 | 10.42651 | 114.2569 | 13.11956 |
| AD-518978.1 | 52.37278 | 11.64162 | 52.48526 | 2.654783 | 90.83673 | 8.68093 | 107.3822 | 14.933 |
| AD-518979.1 | 66.15803 | 16.38301 | 43.33509 | 7.856349 | 73.18861 | 5.884268 | 111.2535 | 30.84103 |
| AD-518980.2 | 102.8949 | 13.60259 | 74.721 | 9.340619 | 102.8776 | 15.689 | 101.1656 | 11.37242 |
| AD-519043.1 | 52.27022 | 1.565815 | 79.56647 | 13.03313 | 90.18324 | 13.00075 | 111.8124 | 14.07459 |
| AD-519340.1 | 50.02449 | 3.164387 | 33.95453 | 5.624572 | 51.64519 | 4.006857 | 89.47256 | 19.92119 |
| AD-519341.1 | 56.5467 | 4.790482 | 33.82173 | 6.439423 | 49.92403 | 4.47156 | 79.71827 | 2.365924 |
| AD-519342.1 | 40.34185 | 2.272544 | 22.97385 | 2.567424 | 47.15934 | 7.164376 | 82.837 | 10.23602 |
| AD-519343.1 | 25.54698 | 3.00203 | 16.9417 | 2.565533 | 33.18726 | 10.34591 | 61.99484 | 12.6374 |
| AD-519344.1 | 30.81974 | 6.324083 | 16.59713 | 2.805304 | 30.37118 | 9.688215 | 47.47176 | 16.77751 |
| AD-519349.1 | 25.64301 | 4.685127 | 24.63817 | 2.5165 | 48.54704 | 6.286199 | 70.48421 | 10.79533 |
| AD-519350.1 | 25.37437 | 5.106213 | 27.95723 | 4.745196 | 35.9648 | 12.83972 | 53.34265 | 8.70051 |
| AD-519477.1 | 55.15233 | 1.53307 | 103.364 | 5.785044 | 105.2844 | 8.074213 | 100.4023 | 3.873633 |
| AD-519596.1 | 49.32799 | 7.794994 | 43.34728 | 6.503345 | 85.37786 | 18.4169 | 95.97131 | 9.683516 |
| AD-519622.1 | 72.31278 | 7.77303 | 76.02368 | 3.15011 | 94.8204 | 6.132603 | 102.1213 | 2.335471 |
| AD-519666.1 | 58.99223 | 9.174687 | 39.62579 | 7.978804 | 41.40143 | 7.590112 | 67.90315 | 15.49473 |
| AD-519667.1 | 39.03083 | 10.13723 | 31.64615 | 5.696646 | 33.87847 | 8.438246 | 52.31223 | 5.003076 |
| AD-519668.1 | 39.28227 | 7.783368 | 21.24655 | 5.859197 | 29.49321 | 3.96825 | 46.35034 | 7.128104 |
| AD-519669.1 | 56.79735 | 2.773505 | 28.77363 | 5.317268 | 34.71547 | 3.827615 | 69.77341 | 9.29004 |
| AD-519670.1 | 63.18069 | 13.12076 | 29.26312 | 4.476751 | 41.51635 | 8.636287 | 68.66003 | 7.79563 |
| AD-519671.1 | 62.08825 | 6.619747 | 31.30349 | 6.066918 | 43.73392 | 3.452455 | 99.40035 | 13.8884 |
| AD-519672.1 | 74.15201 | 10.12734 | 58.05233 | 10.35856 | 76.76989 | 0.667929 | 96.65461 | 3.977393 |
| AD-519691.1 | 45.7187 | 10.19413 | 46.15352 | 17.94174 | 51.34247 | 11.97931 | 72.33644 | 1.687884 |
| AD-519692.1 | 69.49335 | 11.27899 | 58.99249 | 11.32724 | 71.02053 | 4.942421 | 101.379 | 17.91804 |
| AD-519693.1 | 54.32562 | 9.364318 | 30.0908 | 3.788583 | 44.37419 | 9.335986 | 80.6514 | 11.02383 |
| AD-519694.1 | 56.31428 | 7.487224 | 30.98432 | 2.54551 | 63.19903 | 12.35092 | 96.9065 | 15.10197 |
| AD-519696.1 | 80.14073 | 4.963576 | 43.18088 | 8.202438 | 64.84407 | 18.69629 | 83.5461 | 2.868943 |
| AD-67554.6 | 32.5344 | 2.785433 | 22.51723 | 5.938662 | 31.29634 | 6.557666 | 44.04866 | 5.20049 |
| AD-519752.2 | 43.34072 | 3.127806 | 29.97457 | 6.32733 | 41.24786 | 11.31367 | 60.23414 | 9.95955 |
| AD-519753.2 | 25.96199 | 5.067472 | 39.32706 | 25.6105 | 38.48882 | 8.751697 | 64.91725 | 5.699831 |
| AD-519754.8 | 50.72396 | 13.31669 | 27.21654 | 1.411721 | 54.10396 | 10.6625 | 71.83422 | 7.262762 |
| AD-519755.4 | 51.58956 | 5.473844 | 29.96824 | 9.177983 | 28.18829 | 2.586248 | 52.79346 | 6.606697 |
| AD-519759.2 | 63.65028 | 3.967476 | 29.80889 | 10.47159 | 56.6665 | 3.437445 | 86.08391 | 12.83687 |
| AD-519760.2 | 62.00693 | 15.41249 | 27.56752 | 3.854633 | 32.43736 | 4.198986 | 55.89127 | 7.165979 |
| AD-519761.2 | 53.73688 | 3.887523 | 28.45853 | 4.818403 | 34.3774 | 1.450402 | 62.30843 | 17.80523 |
| AD-519766.2 | 50.21221 | 9.519207 | 36.33141 | 4.453995 | 58.6345 | 8.810374 | 83.37992 | 5.951691 |
| AD-519773.1 | 29.88908 | 3.299812 | 30.49178 | 2.190343 | 34.55642 | 5.012424 | 54.0685 | 3.92445 |
| AD-519776.1 | 33.56361 | 9.147108 | 63.08933 | 15.8987 | 66.12198 | 6.090349 | 88.88788 | 0.928982 |
| AD-519777.1 | 58.78548 | 20.27898 | 74.51794 | 17.44182 | 97.80863 | 5.93003 | 98.35458 | 10.33761 |
| AD-519779.1 | 60.65973 | 4.346633 | 93.14756 | 16.52411 | 91.62632 | 14.29083 | 92.46408 | 5.672111 |
| AD-519809.1 | 51.34968 | 4.70846 | 31.02454 | 4.751388 | 44.22855 | 9.42411 | 69.09952 | 9.938716 |
| AD-519810.1 | 52.77966 | 4.812098 | 37.18433 | 11.01069 | 50.95422 | 11.30566 | 76.54755 | 17.24326 |
| AD-519811.1 | 41.83074 | 5.570013 | 55.95473 | 19.52748 | 52.55232 | 4.130694 | 79.87171 | 11.5627 |
| AD-519814.1 | 43.6037 | 4.666228 | 80.65601 | 11.97305 | 87.82249 | 9.563659 | 90.47957 | 3.164596 |
| AD-519820.1 | 35.46836 | 5.787243 | 49.55763 | 10.92159 | 66.90424 | 11.27349 | 80.7228 | 6.515261 |
| AD-519821.1 | 30.70277 | 3.62287 | 61.38392 | 4.112118 | 86.7722 | 7.718429 | 89.74907 | 4.664017 |
| AD-519822.1 | 24.09065 | 3.392701 | 27.8375 | 11.24935 | 45.27112 | 14.85539 | 62.86481 | 9.88856 |
| AD-519823.1 | 53.12406 | 7.898687 | 40.64473 | 18.3133 | 45.90214 | 13.72145 | 71.43003 | 18.06916 |
| AD-519826.1 | 42.85731 | 2.286875 | 47.85482 | 5.871376 | 57.48068 | 5.578858 | 83.69736 | 3.162118 |
| AD-519827.1 | 79.38389 | 3.13229 | 40.34436 | 4.544035 | 84.1747 | 8.546728 | 91.28862 | 3.911967 |
| AD-519828.3 | 37.66239 | 5.17373 | 43.15043 | 3.723005 | 56.13689 | 4.544683 | 78.29178 | 4.68741 |
| AD-519830.1 | 47.12815 | 8.031646 | 48.07977 | 17.07435 | 61.61371 | 6.12148 | 90.1255 | 12.71259 |
| AD-519832.1 | 34.91341 | 4.749048 | 64.86568 | 17.49753 | 68.30678 | 3.626538 | 91.33426 | 13.59467 |

TABLE 35-continued

| | PNPLA3 Single Dose Screen in Primary Cynomolgus Hepatocytes (PCH) | | | | | | | |
|---|---|---|---|---|---|---|---|---|
| | 50 nM | | 10 nM | | 1 nM | | 0.1 nM | |
| Duplex | Avg | SD | Avg | SD | Avg | SD | Avg | SD |
| AD-519887.1 | 32.15966 | 9.58332 | 65.48012 | 7.894547 | 72.84913 | 4.3847 | 92.60784 | 5.197678 |
| AD-519888.1 | 54.53395 | 11.20725 | 31.50922 | 3.110488 | 91.69969 | 3.187794 | 103.071 | 9.793602 |
| AD-519889.1 | 57.80795 | 12.25515 | 51.35477 | 5.076291 | 76.78919 | 7.739237 | 95.46322 | 11.52165 |
| AD-519890.1 | 71.77843 | 5.504303 | 64.796 | 11.40644 | 87.89867 | 15.0868 | 91.90634 | 3.389965 |
| AD-519929.1 | 51.24411 | 4.482367 | 39.80655 | 22.3568 | 46.70825 | 12.81069 | 67.24068 | 6.3593 |
| AD-519931.1 | 50.30644 | 3.56686 | 35.76478 | 6.184685 | 39.3523 | 9.958837 | 59.53076 | 3.383324 |
| AD-519932.1 | 31.44614 | 11.99819 | 32.37951 | 19.35007 | 37.62279 | 5.878389 | 55.21232 | 5.642967 |
| AD-519933.1 | 32.84923 | 3.175817 | 32.48347 | 7.87957 | 71.16852 | 27.0411 | 78.68581 | 4.365061 |
| AD-519935.2 | 23.19916 | 5.459604 | 31.95322 | 8.550425 | 40.71946 | 8.767387 | 70.20499 | 7.920042 |
| AD-519942.1 | 33.43069 | 7.462724 | 50.81118 | 9.662815 | 71.10903 | 10.55588 | 83.13999 | 6.804144 |
| AD-520005.1 | 54.87907 | 8.873501 | 69.27955 | 6.115951 | 85.07006 | 6.620292 | 88.0046 | 3.067445 |
| AD-520006.1 | 24.04719 | 2.376527 | 98.12066 | 13.8079 | 81.4189 | 5.359304 | 87.97026 | 6.179845 |
| AD-520007.1 | 16.0072 | 2.896706 | 65.2408 | 12.45506 | 76.75044 | 17.42631 | 89.26613 | 7.321347 |
| AD-520008.1 | 70.54243 | 7.357645 | 90.52422 | 5.629111 | 112.8555 | 12.18067 | 110.4207 | 28.5502 |
| AD-520011.1 | 61.34677 | 18.83765 | 96.91868 | 10.10156 | 98.16977 | 15.5554 | 112.8618 | 30.05178 |
| AD-520020.1 | 56.73076 | 8.466195 | 47.01322 | 4.272449 | 58.86832 | 6.769924 | 90.48843 | 16.95068 |
| AD-520021.1 | 58.05942 | 7.510224 | 25.28068 | 3.221174 | 43.14391 | 3.700495 | 77.34291 | 4.43031 |
| AD-520022.1 | 60.33364 | 4.301973 | 72.83127 | 2.803794 | 84.01748 | 6.444848 | 91.72618 | 5.273958 |
| AD-520023.1 | 53.1275 | 5.840407 | 73.45791 | 2.587847 | 93.04343 | 2.063577 | 109.9385 | 8.268382 |
| AD-520024.1 | 37.0917 | 8.452936 | 64.47736 | 6.189783 | 71.63681 | 2.311097 | 101.2265 | 11.3285 |
| AD-520025.1 | 36.99918 | 5.011139 | 101.3805 | 10.46419 | 99.36336 | 1.178845 | 125.1059 | 22.39854 |
| AD-520034.1 | 50.74447 | 16.90927 | 101.1502 | 6.872769 | 102.561 | 8.055655 | 112.4464 | 30.31735 |
| AD-520035.3 | 47.68497 | 13.2744 | 93.78555 | 3.138244 | 100.1176 | 8.06161 | 98.20826 | 14.06374 |
| AD-520036.1 | 62.46816 | 8.270828 | 99.50618 | 4.35277 | 107.4029 | 6.917039 | 89.79064 | 10.87267 |
| AD-520037.1 | 56.5259 | 8.816028 | 82.54556 | 13.37586 | 109.9246 | 4.245039 | 96.29902 | 5.863261 |
| AD-520038.1 | 51.75385 | 18.57013 | 102.8392 | 8.317021 | 95.4829 | 1.332827 | 93.45705 | 10.27244 |
| AD-520053.1 | 41.77559 | 8.867003 | 23.59732 | 7.625737 | 27.52882 | 4.75974 | 59.16995 | 5.396248 |
| AD-520060.3 | 44.68219 | 8.424713 | 16.8034 | 1.660673 | 28.01705 | 2.276751 | 51.331 | 2.939989 |
| AD-520061.3 | 28.67808 | 4.381034 | 13.29874 | 1.854016 | 37.21291 | 13.30954 | 52.88488 | 7.318163 |
| AD-520064.5 | 48.04944 | 8.872461 | 16.34754 | 4.443817 | 26.32244 | 4.7663 | 59.63678 | 12.49412 |
| AD-520065.4 | 66.23067 | 11.50931 | 16.51615 | 1.555023 | 22.67985 | 3.273242 | 50.31799 | 14.32623 |
| AD-520066.2 | 95.65312 | 47.68023 | 18.82186 | 1.942078 | 24.67161 | 0.48992 | 39.66911 | 3.815141 |
| AD-520067.3 | 105.1375 | 37.57514 | 16.24075 | 2.266037 | 21.7748 | 1.517695 | 47.79545 | 2.382244 |
| AD-75289.4 | 56.22618 | 10.19969 | 24.54127 | 12.60091 | 39.53389 | 3.948394 | 64.83497 | 3.070942 |
| AD-520068.3 | 70.91495 | 2.704445 | 27.78887 | 2.168692 | 40.12321 | 8.960175 | 74.079 | 7.777185 |
| AD-520069.3 | 39.78116 | 11.92992 | 26.46514 | 3.712465 | 36.37967 | 5.03883 | 69.82406 | 8.52398 |
| AD-520087.1 | 68.98191 | 8.459896 | 50.20663 | 11.44661 | 81.35279 | 14.63565 | 94.63964 | 15.23652 |
| AD-520095.1 | 81.69757 | 9.807112 | 32.2698 | 2.79685 | 40.69272 | 3.69408 | 69.19573 | 1.070516 |
| AD-520096.1 | 64.90297 | 1.936481 | 25.00834 | 2.580411 | 37.05238 | 5.070033 | 58.76053 | 3.332699 |
| AD-520098.2 | 112.056 | 49.26435 | 28.88694 | 6.464563 | 34.33808 | 2.157562 | 62.1349 | 10.38576 |
| AD-75256.2 | 75.79616 | 8.737346 | 47.65446 | 11.90689 | 64.17225 | 3.644674 | 87.85404 | 8.070264 |
| AD-520099.3 | 59.03481 | 13.43313 | 25.29062 | 8.515026 | 37.29785 | 1.900832 | 72.75344 | 8.630579 |
| AD-67575.8 | 35.92082 | 6.119518 | 32.1524 | 7.330741 | 32.35538 | 4.756249 | 69.60965 | 8.477324 |
| AD-520101.3 | 58.99073 | 10.67199 | 28.93054 | 6.61911 | 36.35128 | 10.79135 | 84.78044 | 31.16482 |
| AD-67605.8 | 59.32836 | 23.51253 | 23.70456 | 2.00817 | 37.35276 | 3.899334 | 64.87945 | 10.10013 |
| AD-520102.1 | 75.87013 | 7.619236 | 41.39641 | 13.01122 | 61.67463 | 5.659235 | 87.90872 | 6.466547 |
| AD-520103.1 | 82.82953 | 7.726372 | 80.61462 | 16.04746 | 90.10485 | 4.645091 | 84.60304 | 6.032456 |
| AD-520123.1 | 102.8972 | 19.3969 | 23.28958 | 3.608176 | 33.1825 | 0.757984 | 58.49549 | 5.609074 |
| AD-520127.1 | 73.10119 | 23.1491 | 34.41508 | 3.002116 | 66.96245 | 3.835703 | 89.71 | 5.774929 |
| AD-520133.1 | 36.1541 | 6.391883 | 27.18259 | 3.059568 | 33.92563 | 6.050576 | 62.97858 | 8.296929 |
| AD-520350.1 | 58.87999 | 14.59136 | 100.8357 | 1.826047 | 102.0606 | 4.816809 | 103.3828 | 15.06595 |
| AD-520351.1 | 71.26303 | 7.088025 | 110.2778 | 18.72946 | 96.78415 | 8.786053 | 98.90987 | 17.25027 |
| AD-520352.2 | 85.42707 | 13.84644 | 90.15955 | 6.926617 | 99.08475 | 1.971048 | 84.18354 | 2.660402 |
| AD-520354.1 | 95.72204 | 19.82589 | 98.02466 | 11.36069 | 101.4274 | 6.452407 | 97.11452 | 14.81708 |
| AD-520391.1 | 129.611 | 19.84147 | 99.27503 | 7.12102 | 100.53 | 8.937246 | 89.18045 | 4.171858 |
| AD-520393.1 | 102.3696 | 22.0114 | 109.5158 | 13.74209 | 100.5261 | 11.22596 | 95.78871 | 5.496628 |
| AD-520467.2 | 57.00049 | 5.905218 | 31.91459 | 2.380219 | 56.31104 | 4.401978 | 78.98328 | 3.377318 |
| AD-520481.1 | 69.55206 | 1.607017 | 93.48413 | 3.90882 | 100.765 | 2.313415 | 105.4742 | 15.47609 |

Example 5. Structure-Activity Relationship Analyses

Based on the in vitro analyses in Example 4, structure-active relationship (SAR) analyses were performed. In particular, additional duplexes were designed, synthesized, and assayed in vitro and in vivo.

siRNAs were designed, synthesized, and prepared using methods known in the art and described above. In vitro screening assays in Hep3B and PCH cells with these siRNAs were performed as described above.

Detailed lists of the unmodified PNPLA3 sense and antisense strand nucleotide sequences are shown in Table 36. Detailed lists of the modified PNPLA3 sense and antisense strand nucleotide sequences are shown in Table 37.

The results of the transfection assays of the dsRNA agents listed in Tables 36 and 37 in Hep3B cells are shown in Table 38. The results of the transfection assays of the dsRNA agents listed in Tables 36 and 37 in primary cynomolgus hepatocytes (PCH) are shown in Table 39.

TABLE 36

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-519341.2 | GCUACCCAUUAGGAUAAUGUU | 2474 | 1208-1228 | AACAUUAUCCUAAUGGGUAGCAA | 2558 | 1206-1228 |
| AD-519342.2 | CUACCCAUUAGGAUAAUGUCU | 2475 | 1209-1229 | AGACAUUAUCCUAAUGGGUAGCA | 2559 | 1207-1229 |
| AD-519343.2 | UACCCAUUAGGAUAAUGUCUU | 2476 | 1210-1230 | AAGACAUUAUCCUAAUGGGUAGC | 2560 | 1208-1230 |
| AD-1010713.1 | ACCCAUUAGGAUAAUGUCUUA | 2477 | 1145-1165 | UAAGACAUUAUCCUAAUGGGUAG | 2561 | 1143-1165 |
| AD-519345.1 | CCCAUUAGGAUAAUGUCUUAU | 2478 | 1212-1232 | AUAAGACAUUAUCCUAAUGGGUA | 2562 | 1210-1232 |
| AD-519346.1 | CCAUUAGGAUAAUGUCUUAUU | 2479 | 1213-1233 | AAUAAGACAUUAUCCUAAUGGGU | 2563 | 1211-1233 |
| AD-519347.1 | CAUUAGGAUAAUGUCUUAUGU | 2480 | 1214-1234 | ACAUAAGACAUUAUCCUAAUGGG | 2564 | 1212-1234 |
| AD-1010714.1 | AUUAGGAUAAUGUCUUAUGUA | 2481 | 1149-1169 | UACAUAAGACAUUAUCCUAAUGG | 2565 | 1147-1169 |
| AD-1010715.1 | UUAGGAUAAUGUCUUAUGUAA | 2482 | 1150-1170 | UUACAUAAGACAUUAUCCUAAUG | 2566 | 1148-1170 |
| AD-519350.2 | UAGGAUAAUGUCUUAUGUAAU | 2483 | 1217-1237 | AUUACAUAAGACAUUAUCCUAAU | 2567 | 1215-1237 |
| AD-519351.7 | AGGAUAAUGUCUUAUGUAAUU | 2484 | 1218-1238 | AAUUACAUAAGACAUUAUCCUAA | 2568 | 1216-1238 |
| AD-519352.1 | GGAUAAUGUCUUAUGUAAUGU | 2485 | 1219-1239 | ACAUUACAUAAGACAUUAUCCUA | 2569 | 1217-1239 |
| AD-519353.1 | GAUAAUGUCUUAUGUAAUGCU | 2486 | 1220-1240 | AGCAUUACAUAAGACAUUAUCCU | 2570 | 1218-1240 |
| AD-519354.1 | AUAAUGUCUUAUGUAAUGCUU | 2487 | 1221-1241 | AAGCAUUACAUAAGACAUUAUCC | 2571 | 1219-1241 |
| AD-519355.1 | UAAUGUCUUAUGUAAUGCUGU | 2488 | 1222-1242 | ACAGCAUUACAUAAGACAUUAUC | 2572 | 1220-1242 |
| AD-519356.1 | AAUGUCUUAUGUAAUGCUGCU | 2489 | 1223-1243 | AGCAGCAUUACAUAAGACAUUAU | 2573 | 1221-1243 |
| AD-519357.1 | AUGUCUUAUGUAAUGCUGCCU | 2490 | 1224-1244 | AGGCAGCAUUACAUAAGACAUUA | 2574 | 1222-1244 |
| AD-519358.1 | UGUCUUAUGUAAUGCUGCCCU | 2491 | 1225-1245 | AGGGCAGCAUUACAUAAGACAUU | 2575 | 1223-1245 |
| AD-519359.1 | GUCUUAUGUAAUGCUGCCCUU | 2492 | 1226-1246 | AAGGGCAGCAUUACAUAAGACAU | 2576 | 1224-1246 |
| AD-519360.1 | UCUUAUGUAAUGCUGCCCUGU | 2493 | 1227-1247 | ACAGGGCAGCAUUACAUAAGACA | 2577 | 1225-1247 |
| AD-1010716.1 | CUUAUGUAAUGCUGCCCUGUA | 2494 | 1162-1182 | UACAGGGCAGCAUUACAUAAGAC | 2578 | 1160-1182 |
| AD-519745.1 | CCCAGCCUCUGAGCUGAGUUU | 2495 | 1733-1753 | AAACUCAGCUCAGAGGCUGGGAU | 2579 | 1731-1753 |
| AD-519746.1 | CCAGCCUCUGAGCUGAGUUGU | 2496 | 1734-1754 | ACAACUCAGCUCAGAGGCUGGGA | 2580 | 1732-1754 |
| AD-519747.1 | CAGCCUCUGAGCUGAGUUGGU | 2497 | 1735-1755 | ACCAACUCAGCUCAGAGGCUGGG | 2581 | 1733-1755 |
| AD-519748.1 | AGCCUCUGAGCUGAGUUGGUU | 2498 | 1736-1756 | AACCAACUCAGCUCAGAGGCUGG | 2582 | 1734-1756 |
| AD-519749.1 | GCCUCUGAGCUGAGUUGGUUU | 2499 | 1737-1757 | AAACCAACUCAGCUCAGAGGCUG | 2583 | 1735-1757 |
| AD-519750.1 | CCUCUGAGCUGAGUUGGUUUU | 2500 | 1738-1758 | AAAACCAACUCAGCUCAGAGGCU | 2584 | 1736-1758 |
| AD-1010717.1 | CUCUGAGCUGAGUUGGUUUUA | 2501 | 1673-1693 | UAAAACCAACUCAGCUCAGAGGC | 2585 | 1671-1693 |
| AD-67554.7 | UCUGAGCUGAGUUGGUUUUAU | 2502 | 1740-1760 | AUAAAACCAACUCAGCUCAGAGG | 2586 | 1738-1760 |
| AD-519752.3 | CUGAGCUGAGUUGGUUUUAUU | 2503 | 1741-1761 | AAUAAAACCAACUCAGCUCAGAG | 2587 | 1739-1761 |

TABLE 36-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-1010718.1 | UGAGCUGAGUUGGUUUUAUGA | 2504 | 1676-1696 | UCAUAAAACCAACUCAGCUCAGA | 2588 | 1674-1696 |
| AD-519754.9 | GAGCUGAGUUGGUUUUAUGAU | 2505 | 1743-1763 | AUCAUAAAACCAACUCAGCUCAG | 2589 | 1741-1763 |
| AD-75276.2 | AGCUGAGUUGGUUUUAUGAAA | 2506 | 1744-1764 | UUUCAUAAAACCAACUCAGCUCA | 2590 | 1742-1764 |
| AD-1010719.1 | GCUGAGUUGGUUUUAUGAAAA | 2507 | 1679-1699 | UUUUCAUAAAACCAACUCAGCUC | 2591 | 1677-1699 |
| AD-519757.3 | CUGAGUUGGUUUUAUGAAAAU | 2508 | 1746-1766 | AUUUUCAUAAAACCAACUCAGCU | 2592 | 1744-1766 |
| AD-519758.2 | UGAGUUGGUUUUAUGAAAAGU | 2509 | 1747-1767 | ACUUUUCAUAAAACCAACUCAGC | 2593 | 1745-1767 |
| AD-519759.3 | GAGUUGGUUUUAUGAAAAGCU | 2510 | 1748-1768 | AGCUUUUCAUAAAACCAACUCAG | 2594 | 1746-1768 |
| AD-67549.2 | AGUUGGUUUUAUGAAAAGCUA | 2511 | 1749-1769 | UAGCUUUUCAUAAAACCAACUCA | 2595 | 1747-1769 |
| AD-519761.3 | GUUGGUUUUAUGAAAAGCUAU | 2512 | 1750-1770 | AUAGCUUUUCAUAAAACCAACUC | 2596 | 1748-1770 |
| AD-519762.2 | UUGGUUUUAUGAAAAGCUAGU | 2513 | 1751-1771 | ACUAGCUUUUCAUAAAACCAACU | 2597 | 1749-1771 |
| AD-1010720.1 | UGGUUUUAUGAAAAGCUAGGA | 2514 | 1686-1706 | UCCUAGCUUUUCAUAAAACCAAC | 2598 | 1684-1706 |
| AD-67558.2 | GGUUUUAUGAAAAGCUAGGAA | 2515 | 1753-1773 | UUCCUAGCUUUUCAUAAAACCAA | 2599 | 1751-1773 |
| AD-1010721.1 | CUGCAAAGAUGAUAACCUUGA | 2516 | 2034-2054 | UCAAGGUUAUCAUCUUUGCAGAC | 2600 | 2032-2054 |
| AD-520009.1 | UGCAAAGAUGAUAACCUUGAU | 2517 | 2101-2121 | AUCAAGGUUAUCAUCUUUGCAGA | 2601 | 2099-2121 |
| AD-520010.1 | GCAAAGAUGAUAACCUUGACU | 2518 | 2102-2122 | AGUCAAGGUUAUCAUCUUUGCAG | 2602 | 2100-2122 |
| AD-1010722.1 | CAAAGAUGAUAACCUUGACUA | 2519 | 2037-2057 | UAGUCAAGGUUAUCAUCUUUGCA | 2603 | 2035-2057 |
| AD-520012.1 | AAAGAUGAUAACCUUGACUAU | 2520 | 2104-2124 | AUAGUCAAGGUUAUCAUCUUUGC | 2604 | 2102-2124 |
| AD-520013.1 | AAGAUGAUAACCUUGACUACU | 2521 | 2105-2125 | AGUAGUCAAGGUUAUCAUCUUUG | 2605 | 2103-2125 |
| AD-1010723.1 | AGAUGAUAACCUUGACUACUA | 2522 | 2040-2060 | UAGUAGUCAAGGUUAUCAUCUUU | 2606 | 2038-2060 |
| AD-1010724.1 | GAUGAUAACCUUGACUACUAA | 2523 | 2041-2061 | UUAGUAGUCAAGGUUAUCAUCUU | 2607 | 2039-2061 |
| AD-1010725.1 | AUGAUAACCUUGACUACUAAA | 2524 | 2042-2062 | UUUAGUAGUCAAGGUUAUCAUCU | 2608 | 2040-2062 |
| AD-1010726.1 | UGAUAACCUUGACUACUAAAA | 2525 | 2043-2063 | UUUUAGUAGUCAAGGUUAUCAUC | 2609 | 2041-2063 |
| AD-520018.7 | GAUAACCUUGACUACUAAAAU | 2526 | 2110-2130 | AUUUUAGUAGUCAAGGUUAUCAU | 2610 | 2108-2130 |
| AD-520019.1 | AUAACCUUGACUACUAAAAAU | 2527 | 2111-2131 | AUUUUUAGUAGUCAAGGUUAUCA | 2611 | 2109-2131 |
| AD-520020.2 | UAACCUUGACUACUAAAAACU | 2528 | 2112-2132 | AGUUUUAGUAGUCAAGGUUAUC | 2612 | 2110-2132 |
| AD-520021.2 | AACCUUGACUACUAAAAACGU | 2529 | 2113-2133 | ACGUUUUAGUAGUCAAGGUUAU | 2613 | 2111-2133 |
| AD-520022.2 | ACCUUGACUACUAAAAACGUU | 2530 | 2114-2134 | AACGUUUUAGUAGUCAAGGUUA | 2614 | 2112-2134 |
| AD-520023.2 | CCUUGACUACUAAAAACGUCU | 2531 | 2115-2135 | AGACGUUUUAGUAGUCAAGGUU | 2615 | 2113-2135 |
| AD-520024.2 | CUUGACUACUAAAAACGUCUU | 2532 | 2116-2136 | AAGACGUUUUAGUAGUCAAGGU | 2616 | 2114-2136 |
| AD-520025.2 | UUGACUACUAAAAACGUCUCU | 2533 | 2117-2137 | AGAGACGUUUUAGUAGUCAAGG | 2617 | 2115-2137 |
| AD-1010727.1 | UGACUACUAAAAACGUCUCCA | 2534 | 2052-2072 | UGGAGACGUUUUAGUAGUCAAG | 2618 | 2050-2072 |
| AD-520027.1 | GACUACUAAAAACGUCUCCAU | 2535 | 2119-2139 | AUGGAGACGUUUUAGUAGUCAA | 2619 | 2117-2139 |
| AD-520028.1 | ACUACUAAAAACGUCUCCAUU | 2536 | 2120-2140 | AAUGGAGACGUUUUAGUAGUCA | 2620 | 2118-2140 |
| AD-520052.1 | AUUUAGAACACCUUUUUCAU | 2537 | 2170-2190 | AUGAAAAGGUGUUCUAAAAUUA | 2621 | 2168-2190 |
| AD-520053.2 | UUUAGAACACCUUUUUCACU | 2538 | 2171-2191 | AGUGAAAAGGUGUUCUAAAAUU | 2622 | 2169-2191 |
| AD-520054.1 | UUAGAACACCUUUUUCACCU | 2539 | 2172-2192 | AGGUGAAAAGGUGUUCUAAAAU | 2623 | 2170-2192 |
| AD-1010728.1 | UUAGAACACCUUUUUCACCUA | 2540 | 2107-2127 | UAGGUGAAAAGGUGUUCUAAAA | 2624 | 2105-2127 |
| AD-1010729.1 | UAGAACACCUUUUUCACCUAA | 2541 | 2108-2128 | UUAGGUGAAAAGGUGUUCUAAA | 2625 | 2106-2128 |

TABLE 36-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-520057.1 | AGAACACCUUUUCACCUAAU | 2542 | 2175-2195 | AUUAGGUGAAAAAGGUGUUCUAA | 2626 | 2173-2195 |
| AD-520058.1 | GAACACCUUUUCACCUAACU | 2543 | 2176-2196 | AGUUAGGUGAAAAAGGUGUUCUA | 2627 | 2174-2196 |
| AD-1010730.1 | AACACCUUUUCACCUAACUA | 2544 | 2111-2131 | UAGUUAGGUGAAAAAGGUGUUCU | 2628 | 2109-2131 |
| AD-1010731.1 | ACACCUUUUCACCUAACUAA | 2545 | 2112-2132 | UUAGUUAGGUGAAAAAGGUGUUC | 2629 | 2110-2132 |
| AD-1010732.1 | CACCUUUUCACCUAACUAAA | 2546 | 2113-2133 | UUUAGUUAGGUGAAAAAGGUGUU | 2630 | 2111-2133 |
| AD-520062.8 | ACCUUUUCACCUAACUAAAU | 2547 | 2180-2200 | AUUUAGUUAGGUGAAAAAGGUGU | 2631 | 2178-2200 |
| AD-520063.4 | CCUUUUCACCUAACUAAAAU | 2548 | 2181-2201 | AUUUUAGUUAGGUGAAAAAGGUG | 2632 | 2179-2201 |
| AD-1010733.1 | CUUUUCACCUAACUAAAAUA | 2549 | 2116-2136 | UAUUUUAGUUAGGUGAAAAAGGU | 2633 | 2114-2136 |
| AD-1010734.1 | UUUUCACCUAACUAAAAUAA | 2550 | 2117-2137 | UUAUUUUAGUUAGGUGAAAAAGG | 2634 | 2115-2137 |
| AD-520066.3 | UUUCACCUAACUAAAAUAAU | 2551 | 2184-2204 | AUUAUUUUAGUUAGGUGAAAAAG | 2635 | 2182-2204 |
| AD-520067.4 | UUCACCUAACUAAAAUAAUU | 2552 | 2185-2205 | AAUUAUUUUAGUUAGGUGAAAAA | 2636 | 2183-2205 |
| AD-75289.5 | UUCACCUAACUAAAAUAAUGU | 2553 | 2186-2206 | ACAUUAUUUUAGUUAGGUGAAAA | 2637 | 2184-2206 |
| AD-520068.4 | UCACCUAACUAAAAUAAUGUU | 2554 | 2187-2207 | AACAUUAUUUUAGUUAGGUGAAA | 2638 | 2185-2207 |
| AD-520069.4 | CACCUAACUAAAAUAAUGUUU | 2555 | 2188-2208 | AAACAUUAUUUUAGUUAGGUGAA | 2639 | 2186-2208 |
| AD-1010735.1 | ACCUAACUAAAAUAAUGUUUA | 2556 | 2123-2143 | UAAACAUUAUUUUAGUUAGGUGA | 2640 | 2121-2143 |
| AD-67584.6 | CCUAACUAAAAUAAUGUUUAA | 2557 | 2190-2210 | UUAAACAUUAUUUUAGUUAGGUG | 2641 | 2188-2210 |

TABLE 37

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-519341.2 | gscsuacccfaUfUfAfggauaauguuL96 | 2642 | asAfscauUfaUfcuaaUfgGfguagcsasa | 2726 | UUGCUACCCAUUAGGAUAAUGUC | 2810 |
| AD-519342.2 | csusacccAfuUfAfGfgauaaugucuL96 | 2643 | asGfsacaUfuAfUfcccaaUfuGfgguagcsa | 2727 | UGCUACCCAUUAGGAUAAUGUCU | 2811 |
| AD-519343.2 | usasccaUfuAfGfGfauaaugucuuL96 | 2644 | asAfsgacAfuUfAfuccuaAfaUfggguasgsc | 2728 | GCUACCCAUUAGGAUAAUGUCUU | 2812 |
| AD-1010713.1 | ascsccauUfaGfGfAfuaaugucuuaL96 | 2645 | usAfsagacUfaUfUfauccUfaAfuggguasasg | 2729 | CUACCCAUUAGGAUAAUGUCUUA | 2813 |
| AD-519345.1 | cscscauuAfgGfAfUfAfaaugucuuauL96 | 2646 | asUfsaagAfcAfUfuauccUfuAfauggsusa | 2730 | UACCCAUUAGGAUAAUGUCUUAU | 2814 |
| AD-519346.1 | cscsauuaGfgAfUfAfAfaugucuuauuL96 | 2647 | asAfsuaaGfaCfAfuuauCfcUfaauggsgsu | 2731 | ACCCAUUAGGAUAAUGUCUUAUG | 2815 |
| AD-519347.1 | csasuuagGfaUfAfAfUfgucuuauguL96 | 2648 | asCfsauaAfgAfCfauuaUfcCfuaaugsgsg | 2732 | CCCAUUAGGAUAAUGUCUUAUGU | 2816 |
| AD-1010714.1 | asusuaggAfuAfAfUfGfucuuauguaL96 | 2649 | usAfscauAfaGfAfcauuAfuCfcuaausgsg | 2733 | CCAUUAGGAUAAUGUCUUAUGUA | 2817 |
| AD-1010715.1 | ususuaggaUfaAfUfGfUfcuuauguaaL96 | 2650 | usUfsacaUfaAfUfacaaUfaUfccuaasusg | 2734 | CAUUAGGAUAAUGUCUUAUGUAA | 2818 |
| AD-519350.2 | usasggauAfaUfGfUfCfuuauguaauL96 | 2651 | asUfsuacAfuAfAfgacaAfuUfauccuasasu | 2735 | AUUAGGAUAAUGUCUUAUGUAAU | 2819 |
| AD-519351.7 | asggauaaUfgUfCfUfuauguaaugL96 | 2652 | asAfsuuaCfaUfAfagacAfuUfauccususa | 2736 | UAGGAUAAUGUCUUAUGUAAUG | 2820 |
| AD-519352.1 | gsgsauaaUfgUfCfUfUfauguaaugcL96 | 2653 | asCfsauuAfcAfUfaagaCfaUfuaucscsu | 2737 | AGGAUAAUGUCUUAUGUAAUGCU | 2821 |
| AD-519353.1 | gsauauaaUfgUfCfUfUfauguaaugcuL96 | 2654 | asGfscauUfaCfAfuaaGfaUfuaucscscsu | 2738 | GGAUAAUGUCUUAUGUAAUGCU | 2822 |
| AD-519354.1 | asuauaauGfuCfUfUfAfuguaaugcuuL96 | 2655 | asAfsgcaUfuAfCfauaaGfaCfauuauscsc | 2739 | GAUAAUGUCUUAUGUAAUGCUG | 2823 |
| AD-519355.1 | usaaaugUfcUfUfAfUfguaaugcugcL96 | 2656 | asCfsagcAfuUfAfCfauaaGfAfcauuasusc | 2740 | AUAAUGUCUUAUGUAAUGCUGC | 2824 |
| AD-519356.1 | asaaugucUfuAfUfGfUfaaugcugccL96 | 2657 | asGfscagCfaUfUfacauAfaGfacauusasu | 2741 | UAAUGUCUUAUGUAAUGCUGCC | 2825 |
| AD-519357.1 | asusgucuUfaUfGfUfaaugcugcccL96 | 2658 | asGfsgcaGfcAfUfuacaUfaAfgacaususa | 2742 | AAUGUCUUAUGUAAUGCUGCCC | 2826 |
| AD-519358.1 | usgsucuuAfuGfUfAfaugcugcccuL96 | 2659 | asGfsggcAfgCfAfUfuacaCfAfAfagacasusu | 2743 | AUGUCUUAUGUAAUGCUGCCCU | 2827 |
| AD-519359.1 | gsusuacuuaUfgUfAfAfugcugccucuL96 | 2660 | asAfsgggCfaGfCfauuaCffAfaagacsasu | 2744 | UGUCUUAUGUAAUGCUGCCCUG | 2828 |
| AD-519360.1 | usscsuuauGfuAfAfUfgcugcccuguL96 | 2661 | asCfsagggGfcAfGfcauuAfcAfuaagascsa | 2745 | UGUCUUAUGUAAUGCUGCCCUGU | 2829 |
| AD-1010716.1 | csusuaugUfaAfUfgCfUfgcugcccuguaL96 | 2662 | usAfsacucCfaGfCfucagCfauUfacUfauaagsasc | 2746 | GUCUUAUGUAAUGCUGCCCUGUA | 2830 |
| AD-519745.1 | cscscagcCfuCfUfGfAfgcugaguugL96 | 2663 | asAfsacucCfaGfCfucagAfgGfcuggsasu | 2747 | AUCCCAGCCUCUGAGCUGAGUUG | 2831 |
| AD-519746.1 | cscsagccUfcUfGfAfGfcugaguuggL96 | 2664 | asCfsaacUfcAfGfcucaGfaGfgcuggsgsa | 2748 | UCCCAGCCUCUGAGCUGAGUUGG | 2832 |
| AD-519747.1 | csasgcccUfcUfGfAfGfcucgaguugguL96 | 2665 | asCfscaacCfuCfAfGfcucAfgGfaggcusgsg | 2749 | CCCAGCCUCUGAGCUGAGUUGGU | 2833 |

TABLE 37-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-519748.1 | asgsccucUfgAfGfCfcugaguugguuL96 | 2666 | asAfsccaAfcUfCfagcucCfaGfaggcusgsg | 2750 | CCAGCCUCUGAGCUGAGUUGGUU | 2834 |
| AD-519749.1 | gscscucugAfgCfUfgagguugguuuL96 | 2667 | asAfsaccAfaCfUfcagcUfCfagaggcusug | 2751 | CAGCCUCUGAGCUGAGUUGGUUU | 2835 |
| AD-519750.1 | cscsucugAfgCfUfGfagucgguuuuL96 | 2668 | asAfsaaccUfaAfCfucagCfuCfagaggccsu | 2752 | AGCCUCUGAGCUGAGUUGGUUUU | 2836 |
| AD-1010717.1 | csusucugaGfcUfGfAfguuggutuuaL96 | 2669 | usAfsaaaAfcCfAfacucaGfcUfcagagsgsc | 2753 | GCCUCUGAGCUGAGUUGGUUUUA | 2837 |
| AD-67554.7 | uscsugagcUfgAfGfUfuggguuuuauL96 | 2670 | asAfsaaaAfcCfAfacucAfgCfucagasgsg | 2754 | CCUCUGAGCUGAGUUGGUUUUAU | 2838 |
| AD-519752.3 | csusgagcUfgAfGfUfUfggguuuuaugL96 | 2671 | asAfsuaaaAfaCfCfaacucCfaGfcucagasg | 2755 | CUCUGAGCUGAGUUGGUUUUAUG | 2839 |
| AD-1010718.1 | usgsagcuGfaGfUfUfUfggutuuaugaL96 | 2672 | usCfsauaAfaAfCfcaacUfCfAfgcucasgsa | 2756 | UCUGAGCUGAGUUGGUUUUAUGA | 2840 |
| AD-519754.9 | gsasgcugAfgUfUfGfGfuuuuaugauL96 | 2673 | asUfscauAfaAfAfCfccaacUfCfagcucsasg | 2757 | CUGAGCUGAGUUGGUUUUAUGAA | 2841 |
| AD-75276.2 | asgcugaGfuUfGfGfuUfuuaugaaaL96 | 2674 | usUfsucaUfaAfAfAfaccaAfcUfcagcusca | 2758 | UGAGCUGAGUUGGUUUUAUGAAA | 2842 |
| AD-1010719.1 | gscsugaGfuUfgGfuUfuUfauggaaaL96 | 2675 | usUfsuucAfuAfAfAfaaccAfaCfucagscsu | 2759 | GAGCUGAGUUGGUUUUAUGAAAA | 2843 |
| AD-519757.3 | csusgaguUfgGfUfUfUfuaugaaaauL96 | 2676 | asUfsuuuCfaUfAfaaaCfAfaCfcucagcscsu | 2760 | AGCUGAGUUGGUUUUAUGAAAAG | 2844 |
| AD-519758.2 | usgsaguUfgGfuUfUfUfuaugaaaaguL96 | 2677 | asCfsuuuUfcAfUfaaaaCfCfAfaacucasgsc | 2761 | GCUGAGUUGGUUUUAUGAAAAGC | 2845 |
| AD-519759.3 | gsasguugGfuUfUfAfAfugaaaagcuL96 | 2678 | asGfscuuUfuCfAfUfuaaaAfcCfctaaccsasg | 2762 | CUGAGUUGGUUUUAUGAAAAGCU | 2846 |
| AD-67549.2 | asgsuuggUfuUfUfAfAfugaaaagcuaL96 | 2679 | usAfsgcuUfuUfCfauaaAfaCfcaacuscsa | 2763 | UGAGUUGGUUUUAUGAAAAGCUA | 2847 |
| AD-519761.3 | gsusuugguUfuAfUfGfaaaagcuagL96 | 2680 | asUfsagcUfuUfUfcauaAfaAfccaacsusc | 2764 | GAGUUGGUUUUAUGAAAAGCUAG | 2848 |
| AD-519762.2 | ususugguUfuAfUfGfAfaaagcuaguL96 | 2681 | asCfsuagCfuUfUfucauAfaAfaccasascu | 2765 | AGUUGGUUUUAUGAAAAGCUAGG | 2849 |
| AD-1010720.1 | usgsguuuUfaUfGfAfAfaagcuaggaL96 | 2682 | usCfsuagGfcUfUfuucaUfaAfaaccsasa | 2766 | GUUGGUUUUAUGAAAAGCUAGGA | 2850 |
| AD-67558.2 | gsgsuuuUfaUfGfAfAfaagcuaggaaL96 | 2683 | usUfsccuAfgCfUfuuucAfaAfaaaccsasa | 2767 | UUGGUUUUAUGAAAAGCUAGGAA | 2851 |
| AD-1010721.1 | csusugcaaAfgAfUfGfAfauaaccugaL96 | 2684 | usCfsaagGfuUfAfucauCfuUfugcagsasc | 2768 | GUCUGCAAAGAUGAUAACCUUGA | 2852 |
| AD-520009.1 | usgscucaaAfgAfUfGfAfuaaccuugaL96 | 2685 | asUfscaaGfgUfUfaucaUfcUfuugcasgsa | 2769 | UCUGCAAAGAUGAUAACCUUGAC | 2853 |
| AD-520010.1 | gscsaaaGfaUfGfAfUfaaccuugacuL96 | 2686 | asGfsucaAfgGfUfuaucAfuCfuuugcsasg | 2770 | CUGCAAAGAUGAUAACCUUGACU | 2854 |
| AD-1010722.1 | csasaagaUfgAfUfAfAfccuugacuaL96 | 2687 | usAfsgucAfaGfGfuuaucAfuCfuuugscsa | 2771 | UGCAAAGAUGAUAACCUUGACUA | 2855 |
| AD-520012.1 | asasagaUfgAfUfAfAfCfccuugacuacL96 | 2688 | asUfsaguCfaAfGfguuaUfcAfucuuugsc | 2772 | GCAAAGAUGAUAACCUUGACUAC | 2856 |
| AD-520013.1 | asasagauGfaUfAfAfCfcuugacucuL96 | 2689 | asGfsuagUfcAfAfgguuAfuCfAfucuususg | 2773 | CAAAGAUGAUAACCUUGACUACU | 2857 |

TABLE 37-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1010723.1 | asgsaugaUfaAfcCfCfuugacuacuaL96 | 2690 | usAfsguaGfuCfAfaggUfaUfcaucuausu | 2774 | AAGAUGAUAACCUUGACUACUA | 2858 |
| AD-1010724.1 | gsasugauAfaCfCfUfugacuacuaaL96 | 2691 | usUfsaguAfgUfCfaaggUfuAfucaucsusu | 2775 | AAGAUAACCUUGACUACUAA | 2859 |
| AD-1010725.1 | asusgauaAfcCfUfUfgacuacuaaaL96 | 2692 | usUfsuagUfaGfUfcaagGfuUfaucausu | 2776 | AGAUAACCUUGACUACUAAA | 2860 |
| AD-1010726.1 | usgsauaaCfcUfUfGfacuacuaaaaL96 | 2693 | usUfsuuaGfuAfGfucaaGfgUfuaucasusu | 2777 | GAUAACCUUGACUACUAAAA | 2861 |
| AD-520018.7 | gsasuaaCfcUfuGfAfcuacuaaaauL96 | 2694 | asUfsuuuAfgUfAfgucaAfgGfuuaucsasu | 2778 | AUGAUAACCUUGACUACUAAAA | 2862 |
| AD-520019.1 | asusaaccUfuGfAfCfuacuaaaauL96 | 2695 | asGfsuuuUfaGfUfaguCfaAfgguuauscsa | 2779 | UGAUAACCUUGACUACUAAAAC | 2863 |
| AD-520020.2 | usaasccuuGfaCfUfAfcuaaaaacgL96 | 2696 | asCfsguuuUfuUfAfguagUfcAfagguuasusu | 2780 | GAUAACCUUGACUACUAAAACG | 2864 |
| AD-520021.2 | asasccuuGfaCfUfUfAfcuaaaaacguL96 | 2697 | asCfsguuuUfuUfUfaguaGfuCfaagguusasu | 2781 | AUAACCUUGACUACUAAAAACGU | 2865 |
| AD-520022.2 | asccuugaCfuAfCfUfaaaaacguuL96 | 2698 | asAfscguUfuUfUfaguaGfuCfaagususa | 2782 | UAACCUUGACUACUAAAAACGUC | 2866 |
| AD-520023.2 | cscsuugaCfuAfCfUfaaaaaacgucuL96 | 2699 | asGfsacgUfuUfUfuaguAfgUfcaagsusu | 2783 | AACCUUGACUACUAAAAACGUCU | 2867 |
| AD-520024.2 | csusugacUfaCfUfAfaaaacgucuL96 | 2700 | asAfsgacGfuUfUfUfuagUfaGfucaagsgsu | 2784 | ACCUUGACUACUAAAAACGUCUC | 2868 |
| AD-520025.2 | ususugacUfaCfUfAfaaaacgucucL96 | 2701 | asGfsagacCfgUfUfuuuaGfuAfgucaasgsg | 2785 | CCUUGACUACUAAAAACGUCUCC | 2869 |
| AD-1010727.1 | usgsacuaCfuAfAfAfAfacgucuccaL96 | 2702 | usGfsgagAfcGfUfUfuuuuAfgUfagucasasg | 2786 | CUUGACUACUAAAAACGUCUCCA | 2870 |
| AD-1010728.1 | gsasucuacUfaAfAfAfAfcgucuccauL96 | 2703 | asUfsggagGfaCfGfuuuuUfuAfgucasasa | 2787 | UUGACUACUAAAAACGUCUCCAU | 2871 |
| AD-1010729.1 | asccuacuAfaAfAfAfAfcgucuccauuL96 | 2704 | asAfsuggaGfaCfGfuuuuUfuAfguagucsa | 2788 | UGACUACUAAAAACGUCUCCAUG | 2872 |
| AD-520052.1 | asusuuuaGfaAfcCfAfccuuuuucauL96 | 2705 | asAfsuggaAfaAfGfguguUfcAfuaaaaususa | 2789 | UAAUUUUAGAACACCUUUUUCAC | 2873 |
| AD-520053.2 | usususuagAfaCfAfCfcuuuuucaccL96 | 2706 | asGfsugaaAfaAfAfAfggucUfuCfuaaaasu | 2790 | AAUUUUAGAACACCUUUUUCACC | 2874 |
| AD-520054.1 | usussuagaAfcAfCfCfuuuuucaccuL96 | 2707 | asGfsguggAfaAfAfAfaggUfuCfuaaaasasu | 2791 | AUUUUAGAACACCUUUUUCACCU | 2875 |
| AD-1010728.1 | usasgsaaCfaCfCfUfuuuuucaccusa | 2708 | usAfsggguGfaAfAfAfaaggUfgUfucuaasasa | 2792 | UUUUAGAACACCUUUUUCACCUA | 2876 |
| AD-1010729.1 | usasgaaCfaCfcCfUfuuuuucaccuaa | 2709 | usUfsaggUfgAfAfAfaaaGfuGfuucusasa | 2793 | UUUAGAACACCUUUUUCACCUAA | 2877 |
| AD-520057.1 | asgsaacaCfcUfuUfUfucaccuaauL96 | 2710 | asUfsuagGfuGfAfaaaaGfgUfguucsusa | 2794 | UUAGAACACCUUUUUCACCUAAC | 2878 |
| AD-520058.1 | gsasacacCfuUfUfUfucaccuaacuL96 | 2711 | asGfsuuaGfGfuGfaaaaAfgGfuguucsusa | 2795 | UAGAACACCUUUUUCACCUAACU | 2879 |
| AD-1010730.1 | asascaccUfuUfUfUfucaccuaacuaL96 | 2712 | usAfsguuAfgGfUfGfaaaAfaGfguuucscsu | 2796 | AGAACACCUUUUUCACCUAACUA | 2880 |
| AD-1010731.1 | ascscaccUfuUfUfCfAfccuaacuaaL96 | 2713 | usUfsaguUfaGfGfugaaAfaAfggugususc | 2797 | GAACACCUUUUUCACCUAACUAA | 2881 |
| AD-1010732.1 | csascuuUfuUfCfAfccuaacuaaaL96 | 2714 | usUfsuagUfuAfGfGfugaaAfaAfaggugsusu | 2798 | AACACCUUUUUCACCUAACUAAA | 2882 |

TABLE 37-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-520062.8 | ascscuuuUfuCfAfCfcuaacuaaauL96 | 2715 | asUfsuuaGfuUfAfgguGfuAfaAfaagusgsu | 2799 | ACACCUUUUCACCUAACUAAAA | 2883 |
| AD-520063.4 | cscsuuuuUfcAfCfCfuaacuaaauL96 | 2716 | asUfsuuuAfgUfUfagguGfaAfaaagsgsug | 2800 | CACCUUUUCACCUAACUAAAAU | 2884 |
| AD-1010733.1 | csusuuuuCfaCfCfUfaacuaaauaL96 | 2717 | usAfsuuuUfaGfUfaggUfgAfaaagsgsu | 2801 | ACCUUUUCACCUAACUAAAAUA | 2885 |
| AD-1010734.1 | ususuuucAfcCfUfAfacuaaaauaL96 | 2718 | usUfsauuUfuAfGfuuagGfuGfaaaasgsg | 2802 | CCUUUUCACCUAACUAAAAUAA | 2886 |
| AD-520066.3 | ususuucaCfcUfAfAfcuaaaauuL96 | 2719 | asUfsuauUfuUfAfguuaGfgUfgaaasasg | 2803 | CUUUUCACCUAACUAAAAUAAU | 2887 |
| AD-520067.4 | ususucacCfuAfAfCfuaaaauaauL96 | 2720 | asAfsuuaUfuUfAfguuAfgGfugaasasa | 2804 | UUUUCACCUAACUAAAAUAAUG | 2888 |
| AD-75289.5 | uuscaccUfaAfCfUfAfaaauguuL96 | 2721 | asCfsauuAfuUfUfaguUfaGfguagaasas | 2805 | UUUUCACCUAACUAAAAAUAAUGU | 2889 |
| AD-520068.4 | uscsaccuAfaCfUfAfAfaauaaugL96 | 2722 | asAfscauUfaUfUfuuagUfuAfggugasasa | 2806 | UUCACCUAACUAAAAUAAUGUUU | 2890 |
| AD-520069.4 | csascuaAfcUfAfAfauuaaauguL96 | 2723 | asAfsacaUfuAfUfuuuaGfuUfaggugsasa | 2807 | UCACCUAACUAAAAUAAUGUUUU | 2891 |
| AD-1010735.1 | ascscuaaCfuaAfAfauaauguuL96 | 2724 | usAfsaacAfuAfUfuuuuAfgUfuaggusgsa | 2808 | UCACCUAACUAAAAUAAUGUUUA | 2892 |
| AD-67584.6 | cscsuaaCfuAfAfAfuaauguuuaL96 | 2725 | usUfsaaacCfaUfUfauuuUfaGfuuaggsusg | 2809 | CACCUAACUAAAAUAAUGUUUAA | 2893 |

TABLE 38

| | PNPLA3 Single Dose Screen in Hep3B Cells | | | | | | | |
|---|---|---|---|---|---|---|---|---|
| | 50 nM | | 10 nM | | 1 nM | | 0.1 nM | |
| Duplex | Avg | SD | Avg | SD | Avg | SD | Avg | SD |
| AD-519341.2 | 52.21351 | 9.72399 | 66.63808 | 2.895261 | 115.7241 | 21.02387 | 107.1347 | 9.759609 |
| AD-519342.2 | 37.71079 | 3.794796 | 65.62938 | 11.05422 | 102.1424 | 16.39283 | 103.5589 | 10.61437 |
| AD-519343.2 | 25.96845 | 4.710585 | 37.97371 | 3.607549 | 107.4286 | 25.18447 | 113.9497 | 11.86309 |
| AD-1010713.1 | 34.60493 | 14.82067 | 36.59308 | 5.337726 | 70.32418 | 8.024292 | 78.80994 | 4.447829 |
| AD-519345.1 | 22.32288 | 9.868964 | 25.18423 | 5.868495 | 65.10216 | 2.459937 | 94.87672 | 13.77126 |
| AD-519346.1 | 20.26202 | 4.882502 | 24.92529 | 9.086903 | 59.48022 | 11.21961 | 88.28443 | 6.544299 |
| AD-519347.1 | 19.10368 | 3.401874 | 24.4461 | 3.123502 | 48.07209 | 18.58102 | 83.26504 | 3.650574 |
| AD-1010714.1 | 31.37001 | 9.990933 | 36.67566 | 2.271094 | 69.29489 | 15.01823 | 74.98269 | 12.36223 |
| AD-1010715.1 | 16.19338 | 3.256379 | 25.12577 | 5.098789 | 60.85548 | 8.686738 | 85.44148 | 14.72008 |
| AD-519350.2 | 28.06864 | 12.63968 | 32.84701 | 4.418529 | 82.48389 | 15.13772 | 93.39421 | 13.52473 |
| AD-519351.7 | 33.88484 | 16.17628 | 33.78721 | 6.620053 | 71.89585 | 15.80254 | 90.4867 | 7.497383 |
| AD-519352.1 | 40.65545 | 6.19204 | 60.36501 | 10.17285 | 113.2654 | 7.292487 | 109.1059 | 15.1724 |
| AD-519353.1 | 44.81905 | 17.20036 | 47.75754 | 1.320646 | 94.73342 | 8.394781 | 90.02693 | 9.494433 |
| AD-519354.1 | 34.56728 | 6.889712 | 35.39008 | 5.779131 | 96.93029 | 26.32896 | 78.94062 | 15.65334 |
| AD-519355.1 | 36.34872 | 3.664761 | 39.64835 | 11.73524 | 74.37666 | 10.15151 | 92.14636 | 20.76655 |
| AD-519356.1 | 39.22631 | 11.96501 | 41.77619 | 4.720679 | 113.64 | 5.511916 | 86.95401 | 15.26991 |
| AD-519357.1 | 59.98484 | 12.63175 | 77.68085 | 9.16923 | 147.7793 | 20.55612 | 122.0946 | 16.731 |
| AD-519358.1 | 80.93125 | 19.23246 | 104.5258 | 17.88605 | 168.0363 | 46.44965 | 125.4269 | 11.7382 |
| AD-519359.1 | 47.93771 | 19.70146 | 54.48883 | 6.769038 | 120.8612 | 28.98598 | 113.0698 | 18.87589 |
| AD-519360.1 | 51.88021 | 2.305568 | 79.62266 | 11.70936 | 127.4202 | 14.54277 | 104.4351 | 16.67458 |
| AD-1010716.1 | 61.44569 | 7.470191 | 75.03329 | 9.85015 | 120.3619 | 11.72527 | 92.32831 | 8.962171 |
| AD-519745.1 | 54.08626 | 4.474803 | 66.53918 | 7.473265 | 93.45095 | 19.42486 | 89.00871 | 18.53944 |
| AD-519746.1 | 61.75012 | 16.4376 | 68.23892 | 8.131801 | 117.0866 | 22.06383 | 83.27749 | 11.83074 |
| AD-519747.1 | 54.70269 | 7.405541 | 78.41627 | 22.95503 | 159.082 | 33.22542 | 127.5855 | 7.255807 |
| AD-519748.1 | 65.97231 | 12.64665 | 75.88878 | 13.07825 | 132.7913 | 7.238703 | 121.5269 | 6.610075 |
| AD-519749.1 | 53.18769 | 11.52972 | 60.79999 | 7.719713 | 104.5054 | 17.13132 | 109.7383 | 20.90164 |
| AD-519750.1 | 43.39469 | 4.611303 | 49.77677 | 7.234957 | 95.78512 | 18.21308 | 89.9017 | 12.82374 |
| AD-1010717.1 | 40.17121 | 3.648584 | 49.80754 | 8.559616 | 103.4496 | 28.49196 | 88.25619 | 12.35317 |
| AD-67554.7 | 29.95814 | 2.516048 | 41.39102 | 2.186988 | 80.61999 | 14.18474 | 80.36522 | 12.59649 |
| AD-519752.3 | 35.50279 | 6.566427 | 44.05242 | 5.616278 | 70.0757 | 7.854597 | 67.1874 | 8.699813 |
| AD-1010718.1 | 53.91995 | 6.177942 | 49.79666 | 7.576005 | 117.297 | 23.82981 | 132.2529 | 18.60175 |
| AD-519754.9 | 63.50346 | 10.99599 | 81.53427 | 7.655464 | 137.8708 | 5.336041 | 150.6811 | 23.78481 |
| AD-75276.2 | 43.76833 | 3.39359 | 54.27132 | 12.55485 | 110.3757 | 32.69547 | 93.1702 | 15.68035 |
| AD-1010719.1 | 47.69971 | 11.07692 | 59.21313 | 4.434726 | 106.8359 | 19.33077 | 103.6515 | 11.85168 |
| AD-519757.3 | 33.85014 | 2.34844 | 50.08412 | 5.579596 | 74.93986 | 9.466204 | 86.56796 | 5.483717 |
| AD-519758.2 | 43.8025 | 3.987581 | 45.81134 | 7.638643 | 86.37357 | 3.983253 | 84.44134 | 7.159128 |
| AD-519759.3 | 49.92008 | 6.958198 | 65.85982 | 22.90039 | 92.37066 | 20.62228 | 88.02301 | 11.24555 |
| AD-67549.2 | 40.81684 | 7.036935 | 41.18702 | 2.409983 | 79.36188 | 24.53416 | 75.45676 | 3.921288 |
| AD-519761.3 | 52.59379 | 9.420365 | 60.05315 | 6.050376 | 110.6665 | 15.70977 | 158.6849 | 22.7737 |
| AD-519762.2 | 62.42972 | 6.590522 | 78.48425 | 9.982384 | 156.4083 | 30.45582 | 138.6577 | 14.49926 |
| AD-1010720.1 | 64.18533 | 2.151443 | 73.60328 | 8.131667 | 142.6825 | 22.50819 | 122.0853 | 35.25396 |
| AD-67558.2 | 59.75756 | 10.22261 | 73.57273 | 19.67153 | 138.1327 | 36.98034 | 104.997 | 8.008329 |
| AD-1010721.1 | 74.90593 | 15.45991 | 82.13895 | 5.893665 | 109.8963 | 16.77037 | 101.386 | 9.636034 |
| AD-520009.1 | 50.61456 | 5.090165 | 56.27976 | 5.404256 | 100.9592 | 34.02186 | 88.93466 | 11.18383 |
| AD-520010.1 | 33.02608 | 4.744807 | 47.43298 | 8.950835 | 75.80949 | 13.90891 | 75.48906 | 4.702905 |
| AD-1010722.1 | 63.11917 | 8.123617 | 52.23517 | 6.720795 | 125.0262 | 41.7076 | 125.9861 | 23.49933 |
| AD-520012.1 | 30.9272 | 6.526604 | 43.07578 | 11.16706 | 88.39469 | 12.68997 | 103.7798 | 24.49013 |
| AD-520013.1 | 41.9009 | 4.238882 | 63.29151 | 7.125221 | 124.7904 | 34.66747 | 104.344 | 13.70604 |
| AD-1010723.1 | 43.01932 | 10.6476 | 72.63283 | 17.44516 | 114.8704 | 43.33915 | 105.7161 | 27.04454 |
| AD-1010724.1 | 26.91853 | 1.618019 | 38.78679 | 2.813816 | 78.07498 | 17.52199 | 85.7066 | 11.74145 |
| AD-1010725.1 | 36.41932 | 6.514834 | 47.58067 | 9.390825 | 71.49476 | 10.14546 | 74.93561 | 9.65005 |
| AD-1010726.1 | 26.60712 | 4.09594 | 42.27913 | 12.7339 | 47.18645 | 17.81605 | 73.13987 | 7.894395 |
| AD-520018.7 | 18.44357 | 6.262576 | 29.11779 | 3.214319 | 66.64326 | 36.12656 | 65.92984 | 5.919764 |
| AD-520019.1 | 30.9879 | 6.706704 | 40.51287 | 1.315161 | 110.6345 | 37.86973 | 132.9561 | 24.06574 |
| AD-520020.2 | 43.19306 | 6.866604 | 53.59392 | 12.8242 | 130.4697 | 25.45931 | 147.5214 | 38.32286 |
| AD-520021.2 | 45.2373 | 5.708867 | 56.12506 | 5.681373 | 107.7844 | 21.34967 | 109.4796 | 4.555275 |
| AD-520022.2 | 44.38727 | 3.592447 | 63.13264 | 9.558727 | 90.93577 | 6.741281 | 122.2097 | 7.654652 |
| AD-520023.2 | 44.84941 | 4.670034 | 68.76309 | 3.408301 | 110.8257 | 11.2628 | 96.42404 | 6.713721 |
| AD-520024.2 | 26.61322 | 1.991881 | 44.74325 | 7.635738 | 86.37162 | 27.17556 | 87.32308 | 11.92624 |
| AD-520025.2 | 30.00974 | 5.75711 | 49.41303 | 8.124655 | 63.23468 | 31.2429 | 79.01933 | 12.73629 |
| AD-1010727.1 | 40.32772 | 11.51333 | 50.63384 | 4.770604 | 84.37513 | 13.33681 | 87.94465 | 21.35558 |
| AD-520027.1 | 50.58705 | 4.549675 | 63.91679 | 8.228882 | 134.9979 | 10.39521 | 116.9236 | 21.88092 |
| AD-520028.1 | 48.1695 | 23.15682 | 56.18631 | 9.338642 | 118.8548 | 28.85886 | 136.3715 | 13.31997 |
| AD-520052.1 | 35.48123 | 3.572863 | 52.33214 | 7.956613 | 101.3041 | 18.89961 | 117.0929 | 16.54513 |
| AD-520053.2 | 25.61558 | 10.29700 | 38.30151 | 6.369982 | 68.81292 | 6.915711 | 82.94108 | 12.72222 |
| AD-520054.1 | 53.65793 | 9.751686 | 71.48438 | 8.270167 | 113.3745 | 15.87967 | 98.42625 | 21.29711 |
| AD-1010728.1 | 32.80095 | 10.45869 | 37.65466 | 2.605574 | 75.27318 | 8.757435 | 78.84613 | 9.210613 |
| AD-1010729.1 | 22.0078 | 5.293667 | 32.18646 | 4.565428 | 68.33047 | 13.32244 | 67.99557 | 7.219904 |
| AD-520057.1 | 38.52799 | 10.39505 | 38.28161 | 5.571138 | 75.44463 | 10.42506 | 103.8287 | 15.21887 |
| AD-520058.1 | 59.14763 | 10.92649 | 59.8011 | 4.162056 | 114.1316 | 37.25307 | 141.0098 | 10.53144 |
| AD-1010730.1 | 40.4781 | 6.024048 | 55.60748 | 3.680185 | 100.0228 | 27.00547 | 112.4548 | 23.44009 |
| AD-1010731.1 | 24.90774 | 6.30736 | 37.25631 | 6.906268 | 77.26408 | 2.016841 | 80.71451 | 8.743286 |
| AD-1010732.1 | 22.08367 | 3.888774 | 31.15355 | 4.133469 | 77.83024 | 21.58935 | 80.54815 | 2.883486 |
| AD-520062.8 | 18.81467 | 2.512378 | 36.65627 | 4.469572 | 66.14384 | 9.074255 | 60.44039 | 8.883144 |

TABLE 38-continued

PNPLA3 Single Dose Screen in Hep3B Cells

| Duplex | 50 nM Avg | 50 nM SD | 10 nM Avg | 10 nM SD | 1 nM Avg | 1 nM SD | 0.1 nM Avg | 0.1 nM SD |
|---|---|---|---|---|---|---|---|---|
| AD-520063.4 | 26.08143 | 3.912924 | 30.58296 | 2.004512 | 62.57235 | 12.42262 | 61.85164 | 3.906668 |
| AD-1010733.1 | 28.41876 | 6.38097 | 36.49689 | 5.497472 | 69.50661 | 8.535372 | 97.67116 | 16.23765 |
| AD-1010734.1 | 39.26943 | 2.250103 | 41.78536 | 2.940417 | 73.32514 | 8.491441 | 113.9301 | 16.01803 |
| AD-520066.3 | 53.94827 | 7.168949 | 63.71949 | 12.08307 | 84.23585 | 9.556703 | 103.0603 | 12.6162 |
| AD-520067.4 | 47.7984 | 18.05231 | 43.02687 | 12.78031 | 79.26626 | 20.89056 | 91.82778 | 14.74887 |
| AD-75289.5 | 47.40988 | 6.156409 | 56.54605 | 7.093207 | 105.8225 | 20.87666 | 103.5825 | 8.552423 |
| AD-520068.4 | 75.24691 | 7.353686 | 61.79409 | 10.56019 | 106.4331 | 12.04378 | 131.3598 | 100.0784 |
| AD-520069.4 | 49.35648 | 17.62018 | 54.35528 | 7.380401 | 87.31947 | 8.168188 | 75.96545 | 3.57541 |
| AD-1010735.1 | 24.390444 | 6.60858 | 29.219511 | 5.6575855 | 58.0864 | 16.974511 | 61.029022 | 7.29078 |
| AD-67584.6 | 33.49671 | 5.09947 | 29.77183 | 1.370337 | 61.85995 | 3.782581 | 84.85692 | 13.49881 |

TABLE 39

PNPLA3 Single Dose Screen in Primary Cynomolgus Hepatocytes (PCH)

| Duplex | 50 nM Avg | 50 nM SD | 10 nM Avg | 10 nM SD | 1 nM Avg | 1 nM SD | 0.1 nM Avg | 0.1 nM SD |
|---|---|---|---|---|---|---|---|---|
| AD-519341.2 | 33.18084 | 4.704386 | 51.77473 | 11.5752 | 102.7701 | 28.44004 | 86.5927 | 19.77298 |
| AD-519342.2 | 18.58562 | 2.337486 | 36.98398 | 12.37523 | 72.89022 | 19.41867 | 88.26393 | 11.36751 |
| AD-519343.2 | 14.92807 | 4.226682 | 25.44275 | 6.942827 | 34.02826 | 9.334955 | 78.65741 | 29.73611 |
| AD-1010713.1 | 17.54145 | 2.864549 | 16.87213 | 0.624218 | 31.41544 | 9.277138 | 46.05722 | 5.815894 |
| AD-519345.1 | 13.0926 | 1.627968 | 17.73351 | 4.187537 | 33.40954 | 11.52569 | 61.76661 | 12.4429 |
| AD-519346.1 | 10.6233 | 1.207162 | 15.80567 | 3.743256 | 25.06314 | 8.677675 | 50.53195 | 18.40728 |
| AD-519347.1 | 12.13834 | 1.973554 | 16.73735 | 3.727868 | 29.75023 | 6.687112 | 72.91558 | 28.98494 |
| AD-1010714.1 | 22.58467 | 5.729209 | 42.90185 | 5.650413 | 53.69003 | 13.75494 | 106.2292 | 31.96262 |
| AD-1010715.1 | 30.47287 | 2.033359 | 42.77617 | 12.49897 | 48.47358 | 7.69011 | 136.89 | 52.34067 |
| AD-519350.2 | 21.67436 | 0.892886 | 30.51011 | 13.75843 | 33.43008 | 3.661736 | 64.39207 | 3.609213 |
| AD-519351.7 | 38.4739 | 3.248472 | 45.75867 | 7.169571 | 42.10825 | 4.048311 | 73.02853 | 7.464011 |
| AD-519352.1 | 22.72899 | 1.379361 | 20.50615 | 1.899178 | 41.65781 | 2.492385 | 81.90975 | 7.028732 |
| AD-519353.1 | 31.25338 | 6.519443 | 40.64245 | 8.24087 | 56.83054 | 9.822431 | 89.05521 | 5.409826 |
| AD-519354.1 | 23.21968 | 0.525641 | 32.99807 | 6.969361 | 35.03392 | 5.055374 | 66.52434 | 5.345017 |
| AD-519355.1 | 23.4425 | 3.045451 | 29.1657 | 11.45662 | 34.05687 | 10.96159 | 68.50802 | 3.06385 |
| AD-519356.1 | 38.10175 | 10.02499 | 45.20675 | 10.47852 | 72.97533 | 11.00292 | 93.51506 | 0.458343 |
| AD-519357.1 | 68.10435 | 5.028706 | 73.60291 | 12.47881 | 113.0562 | 9.035648 | 123.3918 | 14.48132 |
| AD-519358.1 | 109.7343 | 17.92171 | 120.1505 | 13.91801 | 101.5 | 15.15514 | 102.0346 | 7.956678 |
| AD-519359.1 | 30.44511 | 3.278255 | 29.70762 | 5.861745 | 61.38724 | 5.037295 | 84.23748 | 4.7701 |
| AD-519360.1 | 71.32011 | 6.26144 | 60.64032 | 5.051455 | 94.20443 | 20.83632 | 105.3515 | 17.96005 |
| AD-1010716.1 | 41.7096 | 3.055802 | 41.9722 | 9.091862 | 65.15609 | 12.01425 | 95.19302 | 7.29294 |
| AD-519745.1 | 43.96581 | 6.84819 | 41.29717 | 11.96036 | 57.69556 | 3.294909 | 101.7143 | 27.79148 |
| AD-519746.1 | 47.49997 | 4.691397 | 49.42224 | 10.30268 | 69.45745 | 1.687739 | 106.0236 | 34.1365 |
| AD-519747.1 | 53.52203 | 9.621605 | 51.35867 | 12.09421 | 88.54727 | 16.1145 | 104.6844 | 15.33743 |
| AD-519748.1 | 35.72106 | 1.970757 | 44.39531 | 12.37111 | 78.95901 | 31.30559 | 93.55954 | 7.035535 |
| AD-519749.1 | 30.27302 | 2.186866 | 35.64525 | 6.3804 | 46.6698 | 13.31953 | 86.65986 | 15.2604 |
| AD-519750.1 | 25.55223 | 1.015786 | 38.29566 | 5.873705 | 42.79628 | 11.71471 | 83.33708 | 17.28221 |
| AD-1010717.1 | 22.19581 | 0.444081 | 28.21198 | 14.87198 | 28.17989 | 2.0589 | 63.12416 | 12.68905 |
| AD-67554.7 | 20.5347 | 2.086194 | 24.32709 | 7.309121 | 24.89249 | 2.097502 | 64.26467 | 26.77638 |
| AD-519752.3 | 25.67992 | 1.931366 | 25.38746 | 5.112742 | 42.34479 | 11.2942 | 75.52802 | 10.90585 |
| AD-1010718.1 | 27.18608 | 3.715747 | 44.69634 | 13.64543 | 48.87007 | 19.38281 | 78.41101 | 3.841614 |
| AD-519754.9 | 24.58058 | 2.85202 | 28.55926 | 7.04754 | 47.1156 | 7.0551 | 71.75772 | 5.289018 |
| AD-75276.2 | 19.94154 | 0.715945 | 24.59512 | 8.783805 | 30.73496 | 3.219686 | 51.97564 | 0.855416 |
| AD-1010719.1 | 18.46757 | 1.784953 | 26.25269 | 12.98876 | 26.24527 | 1.8937 | 53.23716 | 8.284764 |
| AD-519757.3 | 17.83558 | 1.13252 | 17.56734 | 2.632221 | 24.14466 | 6.652008 | 58.05775 | 6.720028 |
| AD-519758.2 | 30.32832 | 14.98666 | 34.33039 | 8.904242 | 41.55164 | 3.189487 | 70.087 | 8.848411 |
| AD-519759.3 | 27.61483 | 3.201485 | 28.96866 | 9.441592 | 51.66033 | 7.747181 | 84.45716 | 2.659745 |
| AD-67549.2 | 25.26417 | 3.325598 | 24.0704 | 8.074096 | 57.06476 | 29.59065 | 66.76109 | 6.859419 |
| AD-519761.3 | 27.29948 | 4.061702 | 29.40234 | 8.2302 | 55.97918 | 17.49415 | 73.8286 | 14.32816 |
| AD-519762.2 | 26.2541 | 2.459677 | 29.08398 | 11.56778 | 47.0892 | 6.508957 | 71.65844 | 6.793264 |
| AD-1010720.1 | 35.10105 | 11.0271 | 54.50536 | 17.15505 | 60.95521 | 6.424327 | 90.65354 | 1.622368 |
| AD-67558.2 | 27.26775 | 1.703701 | 31.83117 | 3.376294 | 48.59497 | 11.6838 | 80.23711 | 9.139227 |
| AD-1010721.1 | 98.73488 | 10.67008 | 88.63852 | 7.615453 | 93.6516 | 8.708677 | 115.0284 | 13.90528 |
| AD-520009.1 | 115.1881 | 12.30103 | 89.73245 | 7.894185 | 118.2456 | 7.323628 | 95.74807 | 5.145745 |
| AD-520010.1 | 79.89452 | 5.894902 | 73.57593 | 14.79716 | 77.45514 | 10.3914 | 94.76517 | 5.195967 |
| AD-1010722.1 | 109.3595 | 4.505885 | 100.8274 | 14.68297 | 95.49468 | 15.87513 | 100.5743 | 0 |
| AD-520012.1 | 97.07213 | 20.47878 | 91.76029 | 9.692549 | 81.80022 | 11.24291 | 94.5523 | 12.13118 |
| AD-520013.1 | 103.4489 | 3.943599 | 108.8068 | 18.33588 | 109.6015 | 12.80929 | 93.2641 | 4.523871 |
| AD-1010723.1 | 27.58843 | 2.338596 | 35.65611 | 10.1328 | 47.56411 | 9.976614 | 90.99518 | 25.74328 |
| AD-1010724.1 | 26.46728 | 1.47565 | 26.90976 | 9.425383 | 41.29731 | 5.581072 | 82.42602 | 17.91712 |
| AD-1010725.1 | 80.0121 | 1.320144 | 71.03697 | 8.193035 | 82.02665 | 7.278687 | 88.37711 | 12.41996 |
| AD-1010726.1 | 63.49658 | 3.453642 | 62.83583 | 7.301534 | 61.38155 | 2.787238 | 79.46593 | 6.682405 |

TABLE 39-continued

PNPLA3 Single Dose Screen in Primary Cynomolgus Hepatocytes (PCH)

| Duplex | 50 nM Avg | 50 nM SD | 10 nM Avg | 10 nM SD | 1 nM Avg | 1 nM SD | 0.1 nM Avg | 0.1 nM SD |
|---|---|---|---|---|---|---|---|---|
| AD-520018.7 | 19.27382 | 1.035111 | 23.71918 | 6.107674 | 42.88368 | 15.39814 | 51.91096 | 6.597352 |
| AD-520019.1 | 67.75371 | 4.815317 | 85.46413 | 27.97837 | 71.69335 | 10.2165 | 76.65592 | 7.666444 |
| AD-520020.2 | 49.64119 | 2.559106 | 51.89577 | 10.90042 | 64.34529 | 12.73844 | 78.40491 | 2.962168 |
| AD-520021.2 | 32.19649 | 2.923462 | 38.97851 | 7.033731 | 44.36721 | 4.429857 | 83.14057 | 9.906269 |
| AD-520022.2 | 88.52092 | 3.683218 | 80.57782 | 9.474541 | 85.40397 | 11.73205 | 85.33902 | 19.51987 |
| AD-520023.2 | 80.54776 | 7.363073 | 79.91236 | 12.3369 | 85.55517 | 8.321525 | 92.01758 | 8.16751 |
| AD-520024.2 | 70.48732 | 4.496364 | 68.08949 | 12.0069 | 63.8255 | 4.218374 | 86.79899 | 6.014172 |
| AD-520025.2 | 106.695 | 7.559647 | 104.8586 | 8.904212 | 91.01226 | 5.278714 | 95.25508 | 5.172506 |
| AD-1010727.1 | 84.29834 | 2.385382 | 79.63431 | 13.52425 | 79.97708 | 9.775323 | 107.7104 | 11.7926 |
| AD-520027.1 | 105.0338 | 10.42553 | 128.6891 | 32.45594 | 91.12301 | 5.761488 | 88.55991 | 5.638937 |
| AD-520028.1 | 84.80983 | 4.623143 | 91.43452 | 13.36049 | 74.04805 | 14.08942 | 86.91035 | 10.10266 |
| AD-520052.1 | 59.00281 | 2.122686 | 70.00039 | 17.00761 | 69.18847 | 13.57631 | 85.22323 | 3.765275 |
| AD-520053.2 | 15.3949 | 1.833054 | 21.17127 | 6.166623 | 26.30001 | 1.075899 | 49.58136 | 3.127215 |
| AD-520054.1 | 30.39768 | 1.557474 | 28.43912 | 1.44968 | 62.62253 | 14.75011 | 80.48458 | 6.455693 |
| AD-1010728.1 | 27.49196 | 18.51724 | 22.77339 | 8.901944 | 27.00153 | 3.445434 | 54.65515 | 5.160433 |
| AD-1010729.1 | 27.52835 | 1.075856 | 36.00578 | 17.45302 | 46.0388 | 21.7126 | 69.47384 | 16.70382 |
| AD-520057.1 | 27.20295 | 3.827477 | 39.78196 | 17.8445 | 61.48804 | 29.47533 | 44.24807 | 1.517811 |
| AD-520058.1 | 19.11994 | 1.596287 | 25.62188 | 10.7099 | 30.55429 | 4.855674 | 73.41137 | 19.43665 |
| AD-1010730.1 | 21.73395 | 10.6979 | 16.70555 | 2.65559 | 32.62999 | 3.77557 | 56.71824 | 9.339537 |
| AD-1010731.1 | 18.79349 | 9.614942 | 20.33723 | 5.175419 | 21.75738 | 3.898997 | 34.06692 | 1.207849 |
| AD-1010732.1 | 12.59156 | 2.240752 | 15.64331 | 7.150228 | 19.65225 | 1.464936 | 34.3364 | 5.246713 |
| AD-520062.8 | 14.21406 | 1.676272 | 15.87543 | 2.458405 | 26.63561 | 8.918796 | 30.5421 | 5.165147 |
| AD-520063.4 | 16.75671 | 8.284338 | 23.80043 | 7.588999 | 32.82854 | 12.10351 | 59.92505 | 16.52704 |
| AD-1010733.1 | 22.32816 | 7.236788 | 25.92854 | 23.7787 | 35.99174 | 17.74611 | 60.47482 | 14.91008 |
| AD-1010734.1 | 18.24302 | 1.752058 | 18.36241 | 1.316487 | 23.71195 | 4.176413 | 41.71739 | 6.863728 |
| AD-520066.3 | 21.0506 | 1.763814 | 23.55916 | 7.45988 | 27.17446 | 7.015571 | 43.35977 | 15.45225 |
| AD-520067.4 | 14.92753 | 1.830658 | 18.13011 | 4.290801 | 35.8336 | 8.2811 | 40.55644 | 8.154041 |
| AD-75289.5 | 26.44845 | 8.977692 | 20.89283 | 2.747366 | 34.44447 | 3.263865 | 83.95798 | 24.73915 |
| AD-520068.4 | 38.03872 | 12.48769 | 46.54654 | 12.13287 | 35.73126 | 8.737018 | 57.92283 | 4.998898 |
| AD-520069.4 | 25.91186 | 7.625084 | 30.85173 | 14.5031 | 31.7561 | 3.069982 | 54.3584 | 6.314143 |
| AD-1010735.1 | 16.92219 | 0.846523 | 35.02702 | 7.741908 | 26.23645 | 1.86282 | 61.5258 | 10.92313 |
| AD-67584.6 | 25.88229 | 6.362588 | 22.72034 | 3.768779 | 30.82832 | 0.453279 | 66.79276 | 7.638439 |

Example 6. In Vivo Screening of dsRNA Duplexes in Mice

Duplexes of interest, identified from the above in vitro SAR studies, were evaluated in vivo. In particular, at pre-dose day −14 wild-type mice (C57BL/6) were transduced by intravenous administration of 2×10$^{10}$ viral particles of an adeno-associated virus 8 (AAV8) vector encoding human PNPLA3. In particular, mice were administered an AAV8 encoding a portion of human PNPLA3 mRNA encoding the open reading frame and 3' UTR of human PNPLA3 mRNA referenced as NM_025225.2, referred to as AAV8-TBG-PI-PNPLA3.

At day 0, groups of three mice were subcutaneously administered a single 10 mg/kg dose of the agents of interest or PBS control. Table 40 provides the treatment groups and Table 41 provides the duplexes of interest. At day 7 post-dose animals were sacrificed, liver samples were collected and snap-frozen in liquid nitrogen. Liver mRNA was extracted and analyzed by the RT-QPCR method.

Figure 5:
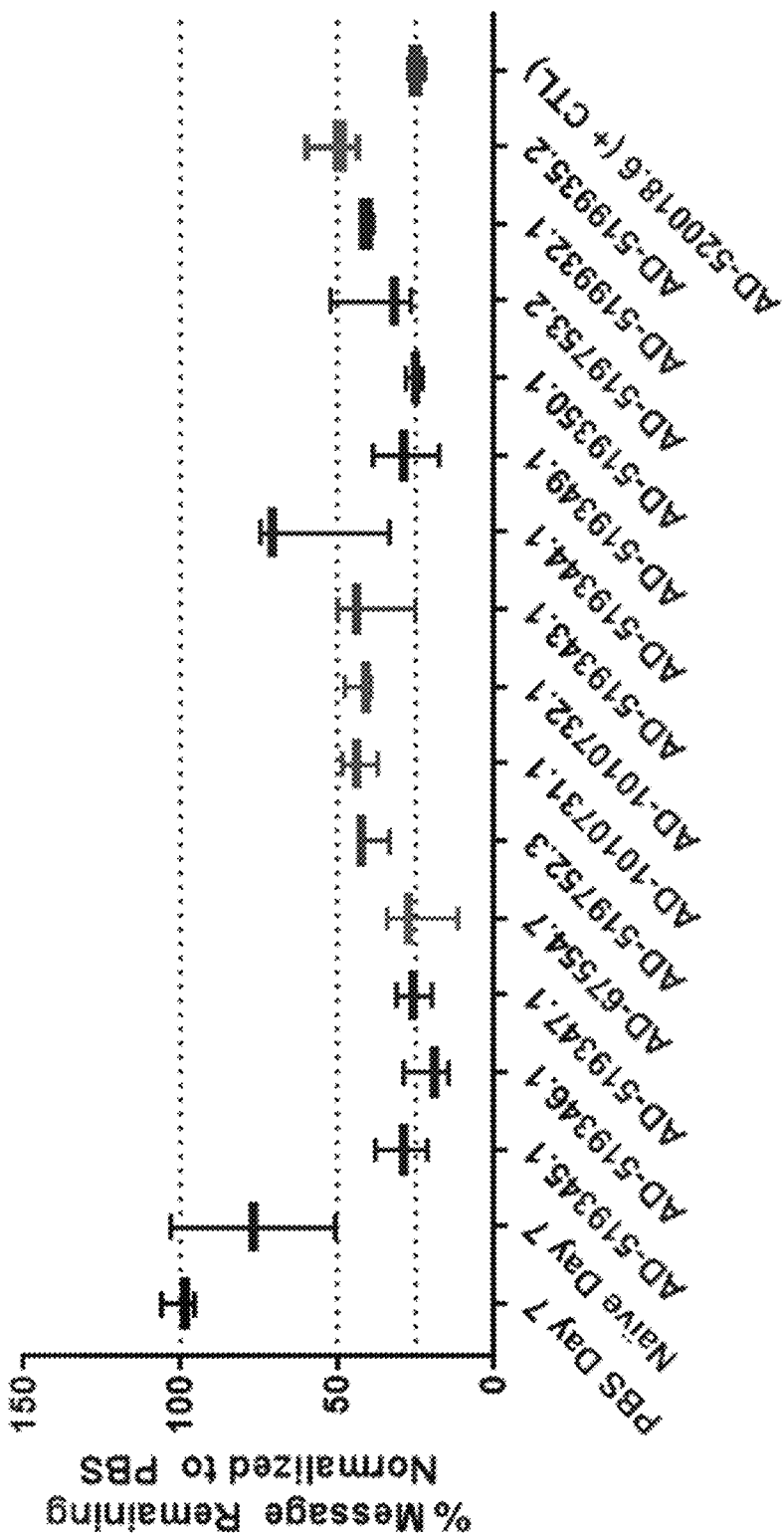
FIG. 5 is a graph showing human PNPLA3 mRNA levels in mice (n=3 per group) subcutaneously administered a single 10 mg/kg dose of the indicated dsRNA duplexes, on day 7 post-dose. Human PNPLA3 mRNA levels are shown relative to control levels detected with PBS treatment.

Human PNPLA3 mRNA levels were compared to a housekeeping gene, GAPDH. The values were then normalized to the average of PBS vehicle control group. The data were expressed as percent of baseline value, and presented as mean plus standard deviation. The results, listed in Table 42 and shown in FIG. 5, demonstrate that the exemplary duplex agents tested effectively reduce the level of the human PNPLA3 messenger RNA in vivo.

TABLE 40

Treatment Groups

| Treatment | Dose | Timepoint |
|---|---|---|
| PBS | n/a | Day 7 |
| Naïve | | |
| AD-519345.1 | | |
| AD-519346.1 | | |
| AD-519347.1 | | |
| AD-67554.7 | | |
| AD-519752.3 | | |
| AD-1010731.1 | | |
| AD-1010732.1 | | |
| AD-519343.1 | | |
| AD-519344.1 | | |
| AD-519349.1 | | |
| AD-519350.1 | | |
| AD-519753.2 | | |
| AD-519932.1 | | |
| AD-519935.2 | | |
| AD-520018.6 (+CTL) | | |

TABLE 41

Duplexes of Interest

| DuplexID | Range in NM_025225.2 |
|---|---|
| AD-519345.1 | 1210-1232 |
| AD-519346.1 | 1211-1233 |
| AD-519347.1 | 1212-1234 |

TABLE 41-continued

Duplexes of Interest

| DuplexID | Range in NM_025225.2 |
|---|---|
| AD-67554.7 | 1738-1760 |
| AD-519752.3 | 1739-1761 |
| AD-1010731.1 | 2110-2132 |
| AD-1010732.1 | 2111-2133 |
| AD-519343.1 | 1208-1230 |
| AD-519344.1 | 1209-1231 |
| AD-519349.1 | 1214-1236 |
| AD-519350.1 | 1215-1237 |
| AD-519753.2 | 1740-1762 |
| AD-519932.1 | 1920-1942 |
| AD-519935.2 | 1923-1945 |
| AD-520018.6 (+CTL) | 2108-2130 |

TABLE 42

| Duplex | % Message Remaining | SD |
|---|---|---|
| PBS Day 7 | 100.83 | 7.41 |
| Naïve Day 7 | 76.79 | 26.41 |
| AD-519346.1 | 20.93 | 7.32 |
| AD-67554.7 | 24.35 | 11.53 |
| AD-520018.6 (+CTL) | 24.99 | 1.97 |
| AD-519350.1 | 25.42 | 2.79 |
| AD-519347.1 | 25.76 | 8.01 |
| AD-519349.1 | 28.37 | 10.58 |
| AD-519345.1 | 29.15 | 8.28 |
| AD-519753.2 | 36.95 | 13.35 |
| AD-519752.3 | 39.67 | 5.40 |
| AD-519343.1 | 39.81 | 12.85 |
| AD-519932.1 | 40.63 | 1.38 |
| AD-1010732.1 | 42.63 | 4.42 |
| AD-1010731.1 | 42.89 | 5.68 |
| AD-519935.2 | 50.93 | 8.55 |
| AD-519344.1 | 59.71 | 22.61 |

Additional duplexes of interest, identified from the above in vitro SAR studies, were evaluated in vivo. In particular, at pre-dose day −14 wild-type mice (C57BL/6) were transduced by intravenous administration of $2\times10^{10}$ viral particles of an adeno-associated virus 8 (AAV8) vector encoding human PNPLA3. In particular, mice were administered an AAV8 encoding the full transcript of NM_025225.2 of human PNPLA3 mRNA, referred to as AAV8-TBG-PI-PNPLA3.

At day 0, groups of three mice were subcutaneously administered a single 10 mg/kg dose of the agents of interest or PBS control. Table 43 provides the treatment groups and Table 44 provides the duplexes of interest. At day 7 post-dose animals were sacrificed, liver samples were collected and snap-frozen in liquid nitrogen. Liver mRNA was extracted and analyzed by the RT-QPCR method.

Figure 6:
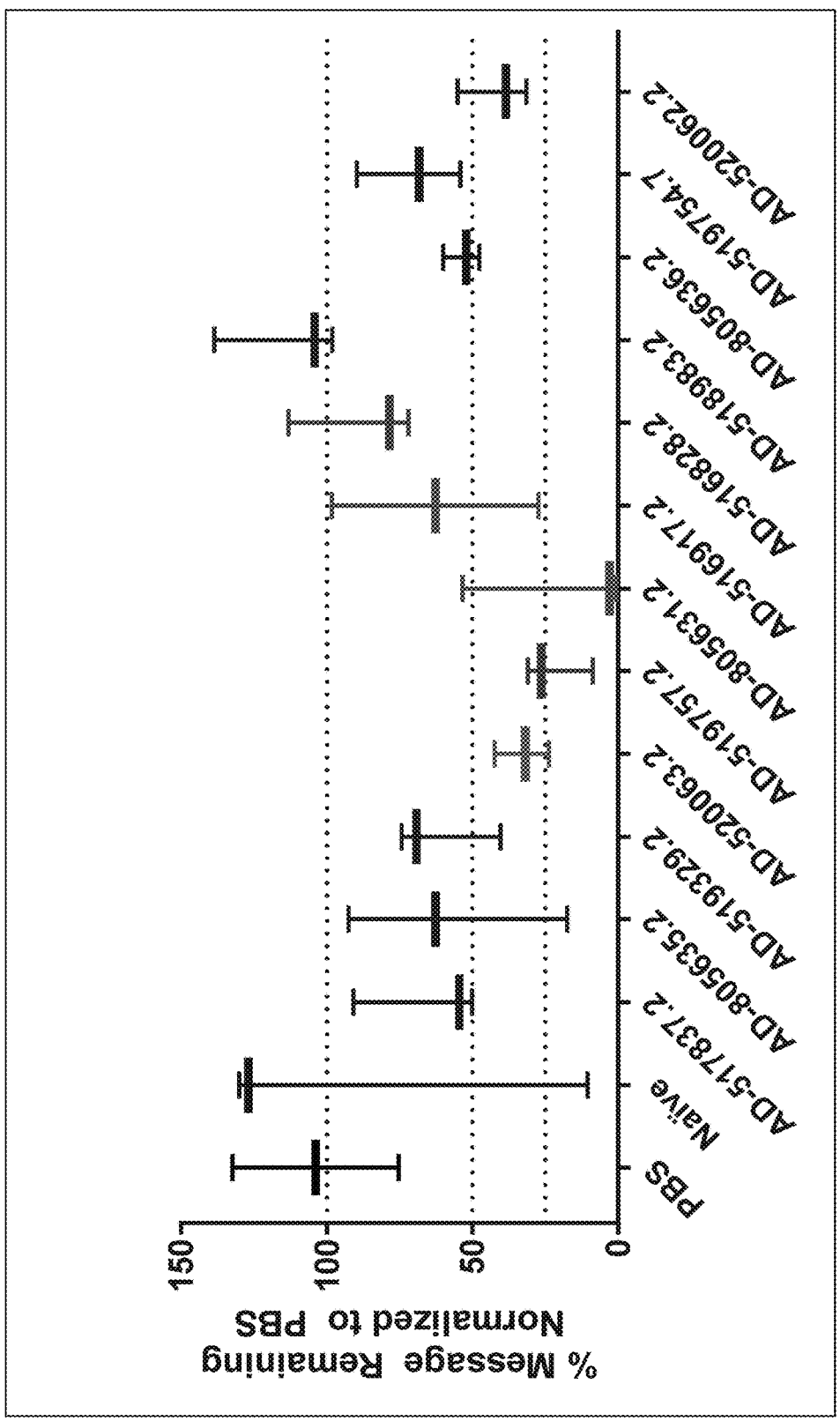
FIG. 6 is a graph showing human PNPLA3 mRNA levels in mice (n=3 per group) subcutaneously administered a single 10 mg/kg dose of the indicated dsRNA duplexes, on day 7 post-dose. Human PNPLA3 mRNA levels are shown relative to control levels detected with PBS treatment.

Human PNPLA3 mLRNA levels were compared to a housekeeping gene, GAPDH. The values were then normalized to the average of PBS vehicle control group. The data were expressed as percent of baseline value, and presented as mean plus standard deviation. The results, listed in Table 45 and shown in FIG. 6, demonstrate that the exemplary duplex agents tested effectively reduce the level of the human PNPLA3 messenger RNA in vivo.

TABLE 43

Treatment Groups

| Group # | Animal # | Treatment | Dose | Timepoint |
|---|---|---|---|---|
| 1 | 1 | PBS | n/a | D7 |
|   | 2 |   |   |   |
|   | 3 |   |   |   |
| 2 | 4 | Naïve | n/a |   |
|   | 5 |   |   |   |
|   | 6 |   |   |   |
| 3 | 7 | AD-517837.2 | 10 mpk |   |
|   | 8 |   |   |   |
|   | 9 |   |   |   |
| 4 | 10 | AD-805635.2 |   |   |
|   | 11 |   |   |   |
|   | 12 |   |   |   |
| 5 | 13 | AD-519329.2 |   |   |
|   | 14 |   |   |   |
|   | 15 |   |   |   |
| 6 | 16 | AD-520063.2 |   |   |
|   | 17 |   |   |   |
|   | 18 |   |   |   |
| 7 | 19 | AD-519757.2 |   |   |
|   | 20 |   |   |   |
|   | 21 |   |   |   |
| 8 | 22 | AD-805631.2 |   |   |
|   | 23 |   |   |   |
|   | 24 |   |   |   |
| 9 | 25 | AD-516917.2 |   |   |
|   | 26 |   |   |   |
|   | 27 |   |   |   |
| 10 | 28 | AD-516828.2 |   |   |
|   | 29 |   |   |   |
|   | 30 |   |   |   |
| 11 | 31 | AD-518983.2 |   |   |
|   | 32 |   |   |   |
|   | 33 |   |   |   |
| 12 | 34 | AD-805636.2 |   |   |
|   | 35 |   |   |   |
|   | 36 |   |   |   |
| 13 | 37 | AD-519754.7 |   |   |
|   | 38 |   |   |   |
|   | 39 |   |   |   |
| 14 | 40 | AD-520062.2 |   |   |
|   | 41 |   |   |   |
|   | 42 |   |   |   |

TABLE 44

Duplexes of Interest

| DuplexID | Range in NM_025225.2 |
|---|---|
| AD-517837.2 | 1901-1923 |
| AD-805635.2 | 2182-2200 |
| AD-519329.2 | 1192-1214 |
| AD-520063.2 | 2179-2201 |
| AD-519757.2 | 1744-1766 |
| AD-805631.2 | 1267-1285 |
| AD-516917.2 | 795-817 |
| AD-516828.2 | 677-699 |
| AD-518983.2 | 773-795 |
| AD-805636.2 | 1219-1237 |
| AD-519754.7 | 1741-1763 |
| AD-520062.2 | 2178-2200 |

TABLE 45

| Duplex | % Message Remaining | SD |
|---|---|---|
| PBS Day 7 | 103.97 | 40.22 |
| Naïve Day 7 | 89.23 | 68.18 |
| AD-517837.2 | 65.26 | 22.46 |
| AD-805635.2 | 57.62 | 37.80 |

TABLE 45-continued

| Duplex | % Message Remaining | SD |
|---|---|---|
| AD-519329.2 | 61.36 | 18.29 |
| AD-520063.2 | 32.76 | 9.36 |
| AD-519757.2 | 22.05 | 11.75 |
| AD-805631.2 | 19.04 | 29.79 |
| AD-516917.2 | 62.84 | 35.48 |
| AD-516828.2 | 88.00 | 22.18 |
| AD-518983.2 | 113.79 | 21.80 |
| AD-805636.2 | 53.33 | 6.27 |
| AD-519754.7 | 70.77 | 17.96 |
| AD-520062.2 | 41.73 | 12.10 |

Additional duplexes of interest, identified from the above in vitro SAR studies, were evaluated in vivo. In particular, at pre-dose day −14 wild-type mice (C57BL/6) were transduced by intravenous administration of $2\times10^{10}$ viral particles of an adeno-associated virus 8 (AAV8) vector encoding human PNPLA3. In particular, mice were administered an AAV8 encoding the open reading frame and 3' UTR of human PNPLA3 mRNA referenced as NM_025225.2, referred to as AAV8-TBG-PI-PNPLA3.

At day 0, groups of three mice were subcutaneously administered a single 10 mg/kg dose of the agents of interest or PBS control. Table 46 provides the treatment groups and Table 47 provides the duplexes of interest. At day 7 post-dose animals were sacrificed, liver samples were collected and snap-frozen in liquid nitrogen. Liver mRNA was extracted and analyzed by the RT-QPCR method.

Figure 7:
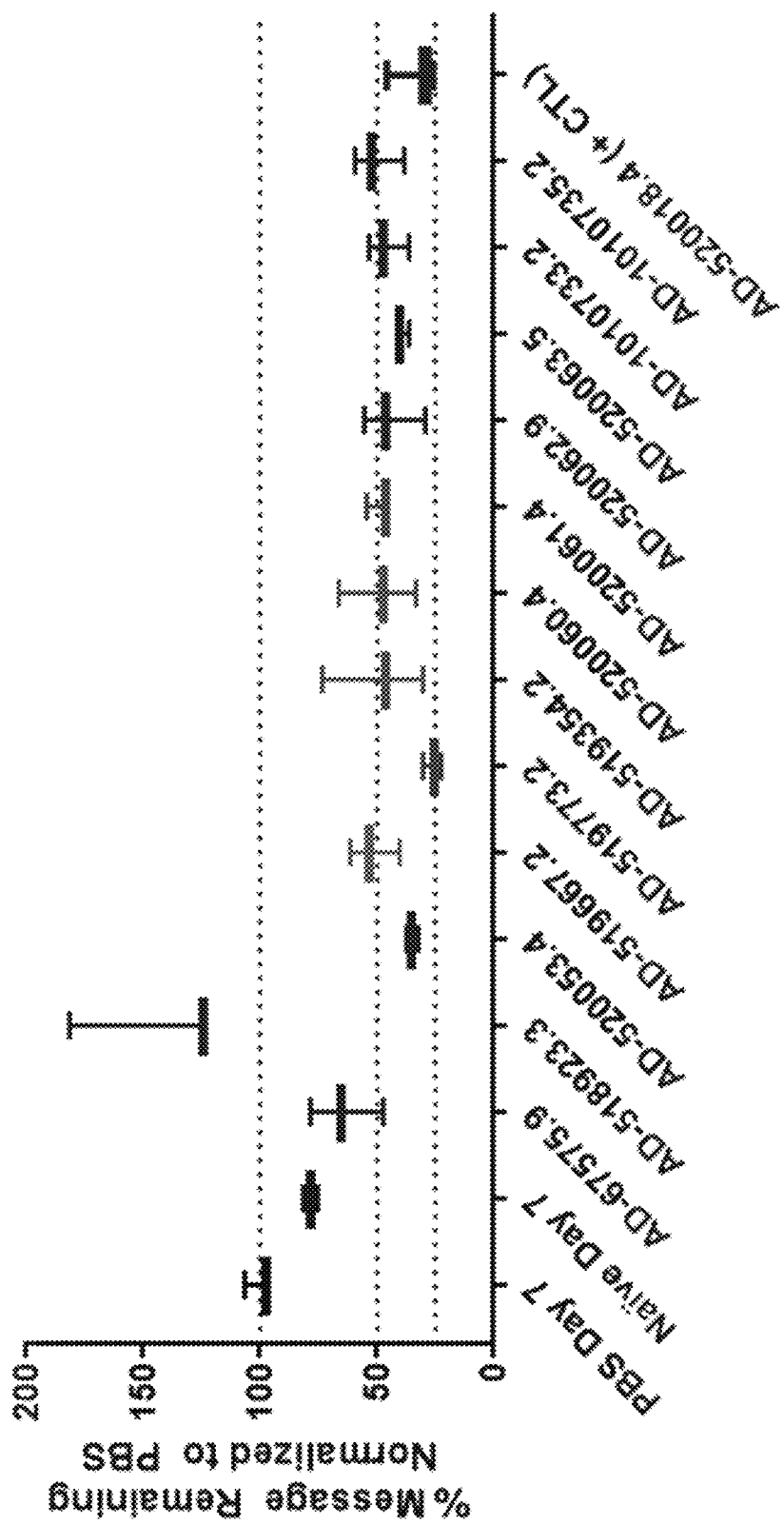
FIG. 7 is a graph showing human PNPLA3 mRNA levels in mice (n=3 per group) subcutaneously administered a single 10 mg/kg dose of the indicated dsRNA duplexes, on day 7 post-dose. Human PNPLA3 mRNA levels are shown relative to control levels detected with PBS treatment.

Human PNPLA3 mRNA levels were compared to a housekeeping gene, GAPDH. The values were then normalized to the average of PBS vehicle control group. The data were expressed as percent of baseline value, and presented as mean plus standard deviation. The results, listed in Table 48 and shown in FIG. 7, demonstrate that the exemplary duplex agents tested effectively reduce the level of the human PNPLA3 messenger RNA in vivo.

TABLE 46

Treatment Groups

| Group # | Animal # | Treatment | Dose | Timepoint |
|---|---|---|---|---|
| 1 | 1 | PBS | n/a | D7 |
|  | 2 |  |  |  |
|  | 3 |  |  |  |
| 2 | 4 | Naïve |  |  |
|  | 5 |  |  |  |
|  | 6 |  |  |  |
| 3 | 7 | AD-67575.9 | 10 mpk |  |
|  | 8 |  |  |  |
|  | 9 |  |  |  |
| 4 | 10 | AD-518923.3 |  |  |
|  | 11 |  |  |  |
|  | 12 |  |  |  |
| 5 | 13 | AD-520053.4 |  |  |
|  | 14 |  |  |  |
|  | 15 |  |  |  |
| 6 | 16 | AD-519667.2 |  |  |
|  | 17 |  |  |  |
|  | 18 |  |  |  |
| 7 | 19 | AD-519773.2 |  |  |
|  | 20 |  |  |  |
|  | 21 |  |  |  |
| 8 | 22 | AD-519354.2 |  |  |
|  | 23 |  |  |  |
|  | 24 |  |  |  |
| 9 | 25 | AD-520060.4 |  |  |
|  | 26 |  |  |  |
|  | 27 |  |  |  |
| 10 | 28 | AD-520061.4 |  |  |
|  | 29 |  |  |  |
|  | 30 |  |  |  |
| 11 | 31 | AD-520062.9 |  |  |
|  | 32 |  |  |  |
|  | 33 |  |  |  |
| 12 | 34 | AD-520063.5 |  |  |
|  | 35 |  |  |  |
|  | 36 |  |  |  |
| 13 | 37 | AD-1010733.2 |  |  |
|  | 38 |  |  |  |
|  | 39 |  |  |  |
| 14 | 40 | AD-1010735.2 |  |  |
|  | 41 |  |  |  |
|  | 42 |  |  |  |
| 15 | 43 | AD-520018.4 (+CTL) |  |  |
|  | 44 |  |  |  |
|  | 45 |  |  |  |

TABLE 47

Duplexes of Interest

| DuplexID | Range in NM_025225.2 |
|---|---|
| AD-67575.9 | 2241-2263 |
| AD-518923.3 | 683-705 |
| AD-520053.4 | 2169-2191 |
| AD-519667.2 | 1631-1653 |
| AD-519773.2 | 1760-1782 |
| AD-519354.2 | 1219-1241 |
| AD-520060.4 | 2176-2198 |
| AD-520061.4 | 2177-2199 |
| AD-520062.9 | 2178-2200 |
| AD-520063.5 | 2179-2201 |
| AD-1010733.2 | 2114-2136 |
| AD-1010735.2 | 2121-2143 |
| AD-520018.4 (+CTL) | 2108-2130 |

TABLE 48

| Duplex | % Message Remaining | SD |
|---|---|---|
| PBS Day 7 | 101.90 | 6.24 |
| Naïve Day 7 | 78.59 | 3.28 |
| AD-519773.2 | 26.03 | 3.77 |
| AD-520018.4 (+CTL) | 33.95 | 10.54 |
| AD-520053.4 | 34.87 | 3.84 |
| AD-520063.5 | 39.46 | 2.44 |
| AD-520062.9 | 43.73 | 13.15 |
| AD-1010733.2 | 45.97 | 8.41 |
| AD-520060.4 | 49.04 | 16.64 |
| AD-520061.4 | 49.32 | 4.29 |
| AD-1010735.2 | 50.04 | 10.92 |
| AD-519354.2 | 50.21 | 22.03 |
| AD-519667.2 | 51.76 | 10.29 |
| AD-67575.9 | 63.91 | 15.29 |
| AD-518923.3 | 143.13 | 33.05 |

Example 7. Design, Synthesis and In Vitro Screening of Additional dsRNA Duplexes Additional siRNAs were designed, synthesized and prepared using methods known in the art and described above in Example 1.

Detailed lists of the additional unmodified PNPLA3 sense and antisense strand nucleotide sequences are shown in Table 49. Detailed lists of the modified PNPLA3 sense and antisense strand nucleotide sequences are shown in Table 50.

Single dose screens of the additional agents were performed by free uptake and transfection.

For free uptake, experiments were performed by adding 2.5 µl of siRNA duplexes in PBS per well into a 96 well plate. Complete growth media (47.5 µl) containing about $1.5 \times 10^4$ primary cynomolgus hepatocytes (PCH) were then added to the siRNA. Cells were incubated for 48 hours prior to RNA purification and RT-qPCR. Single dose experiments were performed at 500 nM, 100 nM, 10, and 1 nM final duplex concentration.

For transfection, Hep3B cells (ATCC, Manassas, Va.) were grown to near confluence at 37° C. in an atmosphere of 5% $CO_2$ in Eagle's Minimum Essential Medium (Gibco) supplemented with 10% FBS (ATCC) before being released from the plate by trypsinization. Transfection was carried out by adding 7.5 µl of Opti-MEM plus 0.1 µl of Lipofectamine RNAiMax per well (Invitrogen, Carlsbad Calif. cat #13778-150) to 2.5 µl of each siRNA duplex to an individual well in a 384-well plate. The mixture was then incubated at room temperature for 15 minutes. Forty µl of complete growth media without antibiotic containing ~$1.5 \times 10^4$ Hep3B cells were then added to the siRNA mixture. Cells were incubated for 24 hours prior to RNA purification. Single dose experiments were performed at 50 nM, 10 nM, 1 nM, and 0.1 nM final duplex concentration.

Total RNA isolation was performed using DYNABEADS. Briefly, cells were lysed in 10l of Lysis/Binding Buffer containing 3 µL of beads per well and mixed for 10 minutes on an electrostatic shaker. The washing steps were automated on a Biotek EL406, using a magnetic plate support. Beads were washed (in 3 µL) once in Buffer A, once in Buffer B, and twice in Buffer E, with aspiration steps in between. Following a final aspiration, complete 12 µL RT mixture was added to each well, as described below.

For cDNA synthesis, a master mix of 1.5 µl 10× Buffer, 0.6 µl 10× dNTPs, 1.5 µl Random primers, 0.75 µl Reverse Transcriptase, 0.75 µl RNase inhibitor and 9.9 µl of $H_2O$ per reaction were added per well. Plates were sealed, agitated for 10 minutes on an electrostatic shaker, and then incubated at 37° C. for 2 hours. Following this, the plates were agitated at 80° C. for 8 minutes.

RT-qPCR was performed as described above and relative fold change was calculated as described above.

The results of the transfection assays of the dsRNA agents listed in Tables 49 and 50 in Hep3B cells are shown in Table 51. The results of the free uptake experiment of the dsRNA agents listed in Tables 49 and 50 in primary cynomolgus hepatocytes (PCH) are shown in Table 52.

TABLE 49

Unmodified Sense and Antisense Strand Sequencesof PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-67554.9 | UCUGAGCUGAGUUGGUUUUAU | 2894 | 1740-1760 | AUAAAACCAACUCAGCUCAGAGG | 3074 | 1738-1760 |
| AD-1193317.1 | UCUGAGCUGAGUUGGUUUUAU | 2895 | 1740-1760 | AUAAAACCAACUCAGCUCAGAGG | 3075 | 1738-1760 |
| AD-1193318.1 | UCUGAGCUGAGUUGGUUUUAU | 2896 | 1740-1760 | ATAAAACCAACTCAGCUCAGAGG | 3076 | 1738-1760 |
| AD-1193319.1 | UCUGAGCUGAGUUGGUUUUAU | 2897 | 1740-1760 | AUAAAACCAACUCAGCUCAGACC | 3077 | 1738-1760 |
| AD-1193320.1 | UCUGAGCUGAGUUGGUUUUAU | 2898 | 1740-1760 | ATAAAACCAACTCAGCUCAGACC | 3078 | 1738-1760 |
| AD-1193321.1 | UGAGCUGAGUUGGUUUUAU | 2899 | 1742-1760 | AUAAAACCAACUCAGCUCAGC | 3079 | 1740-1760 |
| AD-1193322.1 | UGAGCUGAGUUGGUUUUAU | 2900 | 1742-1760 | ATAAAACCAACTCAGCUCAGC | 3080 | 1740-1760 |
| AD-1193344.1 | UCUGAGCUGAGUUGGUUUUAU | 2901 | 1740-1760 | AUAAAACCAACUCAGCUCAGAGG | 3081 | 1738-1760 |
| AD-1193324.1 | UCUGAGCUGAGUUGGUUUUAU | 2902 | 1740-1760 | AUAAAACCAACUCAGCUCAGAGG | 3082 | 1738-1760 |
| AD-1193325.1 | UCUGAGCUGAGUUGGUUUUAU | 2903 | 1740-1760 | AUAAAACCAACUCAGCUCAGAGG | 3083 | 1738-1760 |
| AD-1193326.1 | UCUGAGCUGAGUUGGUUUUAU | 2904 | 1740-1760 | AUAAAACCAACUCAGCUCAGAGG | 3084 | 1738-1760 |
| AD-1193327.1 | UCUGAGCUGAGUUGGUUUUAU | 2905 | 1740-1760 | AUAAAACCAACUCAGCUCAGAGG | 3085 | 1738-1760 |
| AD-1193328.1 | UCUGAGCUGAGUUGGUUUUAU | 2906 | 1740-1760 | AUAAAACCAACUCAGCUCAGAGG | 3086 | 1738-1760 |
| AD-1193329.1 | UCUGAGCUGAGUUGGUUUUAU | 2907 | 1740-1760 | AUAAAACCAACUCAGCUCAGACC | 3087 | 1738-1760 |
| AD-1193330.1 | UCUGAGCUGAGUUGGUUUUAU | 2908 | 1740-1760 | AUAAAACCAACUCAGCUCAGACC | 3088 | 1738-1760 |
| AD-1193331.1 | UCUGAGCUGAGUUGGUUUUAU | 2909 | 1740-1760 | AUAAAACCAACUCAGCUCAGACC | 3089 | 1738-1760 |
| AD-1193332.1 | UGAGCUGAGUUGGUUUUAU | 2910 | 1742-1760 | AUAAAACCAACUCAGCUCAGC | 3090 | 1740-1760 |
| AD-1193333.1 | UGAGCUGAGUUGGUUUUAU | 2911 | 1742-1760 | AUAAAACCAACUCAGCUCAGC | 3091 | 1740-1760 |
| AD-1193334.1 | UGAGCUGAGUUGGUUUUAU | 2912 | 1742-1760 | AUAAAACCAACUCAGCUCAGC | 3092 | 1740-1760 |
| AD-1193335.1 | UCUGAGCUGAGUUGGUUUUAU | 2913 | 1740-1760 | ATAAAACCAACTCAGCUCAGAGG | 3093 | 1738-1760 |
| AD-1193336.1 | UCUGAGCUGAGUUGGUTUUAU | 2914 | 1740-1760 | ATAAAACCAACTCAGCUCAGAGG | 3094 | 1738-1760 |

TABLE 49-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-519346.3 | CCAUUAGGAUAAUGUCUUAUU | 2915 | 1213-1233 | AAUAAGACAUUAUCCUAAUGGGU | 3095 | 1211-1233 |
| AD-1193337.1 | CCAUUAGGAUAAUGUCUUAUU | 2916 | 1213-1233 | AAUAAGACAUUAUCCUAAUGGGU | 3096 | 1211-1233 |
| AD-1193338.1 | CCAUUAGGAUAAUGUCUUAUU | 2917 | 1213-1233 | AAUAAGACAUUAUCCUAAUGGGU | 3097 | 1211-1233 |
| AD-1193339.1 | CCAUUAGGAUAAUGUCUUAUU | 2918 | 1213-1233 | AAUAAGACAUUAUCCUAAUGGCC | 3098 | 1211-1233 |
| AD-1193340.1 | CCAUUAGGAUAAUGUCUUAUU | 2919 | 1213-1233 | AAUAAGACAUUAUCCUAAUGGCC | 3099 | 1211-1233 |
| AD-1193341.1 | CCAUUAGGAUAAUGUCUUAUU | 2920 | 1213-1233 | AAUAAGACAUUAUCCUAAUGGGU | 3100 | 1211-1233 |
| AD-1193342.1 | CCAUUAGGAUAAUGUCUUAUU | 2921 | 1213-1233 | AAUAAGACAUUAUCCUAAUGGGU | 3101 | 1211-1233 |
| AD-1193343.1 | CCAUUAGGAUAAUGUCUUAUU | 2922 | 1213-1233 | AAUAAGACAUUAUCCUAAUGGCC | 3102 | 1211-1233 |
| AD-1193344.1 | CCAUUAGGAUAAUGUCUUAUU | 2923 | 1213-1233 | AAUAAGACAUUAUCCUAAUGGCC | 3103 | 1211-1233 |
| AD-1193345.1 | AUUAGGAUAAUGUCUUAUU | 2924 | 1215-1233 | AAUAAGACAUUAUCCUAAUGG | 3104 | 1213-1233 |
| AD-1193346.1 | AUUAGGAUAAUGUCUUAUU | 2925 | 1215-1233 | AAUAAGACAUUAUCCUAAUGG | 3105 | 1213-1233 |
| AD-1193347.1 | CCAUUAGGAUAAUGUCUUAUU | 2926 | 1213-1233 | AAUAAGACAUUAUCCUAAUGGGU | 3106 | 1211-1233 |
| AD-1193348.1 | CCAUUAGGAUAAUGUCUUAUU | 2927 | 1213-1233 | AAUAAGACAUUAUCCUAAUGGGU | 3107 | 1211-1233 |
| AD-1193349.1 | CCAUUAGGAUAAUGUCUAUU | 2928 | 1213-1233 | AAUAAGACAUUAUCCUAAUGGGU | 3108 | 1211-1233 |
| AD-519347.4 | CAUUAGGAUAAUGUCUUAUGU | 2929 | 1214-1234 | ACAUAAGACAUUAUCCUAAUGGG | 3109 | 1212-1234 |
| AD-1193350.1 | CAUUAGGAUAAUGUCUUAUGU | 2930 | 1214-1234 | ACAUAAGACAUUAUCCUAAUGGG | 3110 | 1212-1234 |
| AD-1193351.1 | CAUUAGGAUAAUGUCUUAUGU | 2931 | 1214-1234 | ACAUAAGACAUUAUCCUAAUGCC | 3111 | 1212-1234 |
| AD-1193352.1 | CAUUAGGAUAAUGUCUUAUGU | 2932 | 1214-1234 | ACAUAAGACAUUAUCCUAAUGGG | 3112 | 1212-1234 |
| AD-1193353.1 | CAUUAGGAUAAUGUCUUAUGU | 2933 | 1214-1234 | ACAUAAGACAUUAUCCUAAUGCC | 3113 | 1212-1234 |
| AD-1193354.1 | UUAGGAUAAUGUCUUAUGU | 2934 | 1216-1234 | ACAUAAGACAUUAUCCUAAUG | 3114 | 1214-1234 |
| AD-1193355.1 | CAUUAGGATAAUGUCUUAUGU | 2935 | 1214-1234 | ACAUAAGACAUUAUCCUAAUGGG | 3115 | 1212-1234 |
| AD-1193356.1 | CAUUAGGATAAUGUCUTAUGU | 2936 | 1214-1234 | ACAUAAGACAUUAUCCUAAUGGG | 3116 | 1212-1234 |
| AD-1193357.1 | CAUUAGGAUAAUGUCUUAUGU | 2937 | 1214-1234 | ACAUAAGACAUUAUCCUAAUGGG | 3117 | 1212-1234 |
| AD-1193358.1 | CAUUAGGAUAAUGUCUTAUGU | 2938 | 1214-1234 | ACAUAAGACAUUAUCCUAAUGGG | 3118 | 1212-1234 |
| AD-519350.4 | UAGGAUAAUGUCUUAUGUAAU | 2939 | 1217-1237 | AUUACAUAAGACAUUAUCCUAAU | 3119 | 1215-1237 |
| AD-1193359.1 | UAGGAUAAUGUCUUAUGUAAU | 2940 | 1217-1237 | AUUACATAAGACAUUAUCCUAAU | 3120 | 1215-1237 |
| AD-1193360.1 | UAGGAUAAUGUCUUAUGUAAU | 2941 | 1217-1237 | AUUACATAAGACAUUAUCCUAAU | 3121 | 1215-1237 |
| AD-1193361.1 | UAGGAUAAUGUCUUAUGUAAU | 2942 | 1217-1237 | AUUACATAAGACAUUAUCCUAGU | 3122 | 1215-1237 |
| AD-1193362.1 | UAGGAUAAUGUCUUAUGUAAU | 2943 | 1217-1237 | AUUACATAAGACAUUAUCCUAGU | 3123 | 1215-1237 |
| AD-1193363.1 | UAGGAUAAUGUCUUAUGUAAU | 2944 | 1217-1237 | AUUACATAAGACAUUAUCCUACC | 3124 | 1215-1237 |
| AD-1193364.1 | UAGGAUAAUGUCUUAUGUAAU | 2945 | 1217-1237 | AUUACATAAGACAUUAUCCUACC | 3125 | 1215-1237 |
| AD-1193365.1 | UAGGAUAAUGUCUUAUGUAAU | 2946 | 1217-1237 | AUUACATAAGACAUUAUCCUAGU | 3126 | 1215-1237 |
| AD-1193366.1 | UAGGAUAAUGUCUUAUGUAAU | 2947 | 1217-1237 | AUUACATAAGACAUUAUCCUAGU | 3127 | 1215-1237 |
| AD-1193367.1 | UAGGAUAAUGUCUUAUGUAAU | 2948 | 1217-1237 | AUUACATAAGACAUUAUCCUAGU | 3128 | 1215-1237 |
| AD-1193368.1 | UAGGAUAAUGUCUUAUGUAAU | 2949 | 1217-1237 | AUUACATAAGACAUUAUCCUAGU | 3129 | 1215-1237 |
| AD-1193369.1 | UAGGAUAAUGUCUUAUGUAAU | 2950 | 1217-1237 | AUUACATAAGACAUUAUCCUAGU | 3130 | 1215-1237 |
| AD-1193370.1 | UAGGAUAAUGUCUUAUGUAAU | 2951 | 1217-1237 | AUUACATAAGACAUUAUCCUAGU | 3131 | 1215-1237 |

TABLE 49-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-1193371.1 | UAGGAUAAUGUCUUAUGUAAU | 2952 | 1217-1237 | AUUACATAAGACAUUAUCCUAGU | 3132 | 1215-1237 |
| AD-1193372.1 | UAGGAUAAUGUCUUAUGUAAU | 2953 | 1217-1237 | AUUACATAAGACAUUAUCCUAGU | 3133 | 1215-1237 |
| AD-519757.4 | CUGAGUUGGUUUUAUGAAAAU | 2954 | 1746-1766 | AUUUUCAUAAAACCAACUCAGCU | 3134 | 1744-1766 |
| AD-1193373.1 | CUGAGUUGGUUUUAUGAAAAU | 2955 | 1746-1766 | AUUUCAUAAAACCAACUCAGCU | 3135 | 1744-1766 |
| AD-1193374.1 | CUGAGUUGGUUUUAUGAAAAU | 2956 | 1746-1766 | AUUUCAUAAAACCAACUCAGCU | 3136 | 1744-1766 |
| AD-1193375.1 | CUGAGUUGGUUUUAUGAAAAU | 2957 | 1746-1766 | AUUUCAUAAAACCAACUCAGUC | 3137 | 1744-1766 |
| AD-1193376.1 | CUGAGUUGGUUUUAUGAAAAU | 2958 | 1746-1766 | AUUUCAUAAAACCAACUCAGUC | 3138 | 1744-1766 |
| AD-1193377.1 | CUGAGUUGGUUUUAUGAAAAU | 2959 | 1746-1766 | AUUUCAUAAAACCAACUCAGCU | 3139 | 1744-1766 |
| AD-1193378.1 | CUGAGUUGGUUUUAUGAAAAU | 2960 | 1746-1766 | AUUUCAUAAAACCAACUCAGCU | 3140 | 1744-1766 |
| AD-1193379.1 | CUGAGUUGGUUUUAUGAAAAU | 2961 | 1746-1766 | AUUUCAUAAAACCAACUCAGCU | 3141 | 1744-1766 |
| AD-1193380.1 | CUGAGUUGGUUUUAUGAAAAU | 2962 | 1746-1766 | AUUUCAUAAAACCAACUCAGCU | 3142 | 1744-1766 |
| AD-1193381.1 | CUGAGUUGGUUUUAUGAAAAU | 2963 | 1746-1766 | AUUUCAUAAAACCAACUCAGUC | 3143 | 1744-1766 |
| AD-1193382.1 | CUGAGUUGGUUUUAUGAAAAU | 2964 | 1746-1766 | AUUUCAUAAAACCAACUCAGUC | 3144 | 1744-1766 |
| AD-1193383.1 | GAGUUGGUUUUAUGAAAAU | 2965 | 1748-1766 | AUUUCAUAAAACCAACUCGG | 3145 | 1746-1766 |
| AD-1193384.1 | GAGUUGGUUUUAUGAAAAU | 2966 | 1748-1766 | AUUUCAUAAAACCAACUCGG | 3146 | 1746-1766 |
| AD-1193385.1 | CUGAGUUGGUUUUAUGAAAAU | 2967 | 1746-1766 | AUUUCAUAAAACCAACUCAGCU | 3147 | 1744-1766 |
| AD-1193386.1 | CUGAGUUGGUUUUAUGAAAAU | 2968 | 1746-1766 | AUUUCAUAAAACCAACUCAGCU | 3148 | 1744-1766 |
| AD-1193387.1 | CUGAGUUGGUUUUAUGAAAAU | 2969 | 1746-1766 | AUUUCAUAAAACCAACUCAGCU | 3149 | 1744-1766 |
| AD-1193388.1 | CUGAGUUGGUUUUAUGAAAAU | 2970 | 1746-1766 | AUUUCAUAAAACCAACUCAGUC | 3150 | 1744-1766 |
| AD-1193389.1 | CUGAGUUGGUUUUAUGAAAAU | 2971 | 1746-1766 | AUUUCAUAAAACCAACUCAGUC | 3151 | 1744-1766 |
| AD-1193390.1 | GAGUUGGUUUUAUGAAAAU | 2972 | 1748-1766 | AUUUCAUAAAACCAACUCGG | 3152 | 1746-1766 |
| AD-1193391.1 | GAGUUGGUUUUAUGAAAAU | 2973 | 1748-1766 | AUUUCAUAAAACCAACUCGG | 3153 | 1746-1766 |
| AD-520018.9 | GAUAACCUUGACUACUAAAAU | 2974 | 2110-2130 | AUUUUAGUAGUCAAGGUUAUCAU | 3154 | 2108-2130 |
| AD-1193392.1 | GAUAACCUUGACUACUAAAAU | 2975 | 2110-2130 | AUUUAGUAGUCAAGGUUAUCAU | 3155 | 2108-2130 |
| AD-1193393.1 | GAUAACCUUGACUACUAAAAU | 2976 | 2110-2130 | AUUUAGUAGUCAAGGUUAUCAU | 3156 | 2108-2130 |
| AD-1193394.1 | GAUAACCUUGACUACUAAAAU | 2977 | 2110-2130 | AUUUAGUAGUCAAGGUUAUCAU | 3157 | 2108-2130 |
| AD-1193395.1 | GAUAACCUUGACUACUAAAAU | 2978 | 2110-2130 | AUUUAGUAGUCAAGGUUAUCGU | 3158 | 2108-2130 |
| AD-1193396.1 | GAUAACCUUGACUACUAAAAU | 2979 | 2110-2130 | AUUUAGUAGUCAAGGUUAUCGU | 3159 | 2108-2130 |
| AD-1193397.1 | GAUAACCUUGACUACUAAAAU | 2980 | 2110-2130 | AUUUAGUAGUCAAGGUUAUCGU | 3160 | 2108-2130 |
| AD-1193398.1 | GAUAACCUUGACUACUAAAAU | 2981 | 2110-2130 | AUUUAGUAGUCAAGGUUAUCAU | 3161 | 2108-2130 |
| AD-1193399.1 | GAUAACCUUGACUACUAAAAU | 2982 | 2110-2130 | AUUUAGUAGUCAAGGUUAUCAU | 3162 | 2108-2130 |
| AD-1193400.1 | GAUAACCUUGACUACUAAAAU | 2983 | 2110-2130 | AUUUAGUAGUCAAGGUUAUCAU | 3163 | 2108-2130 |
| AD-1193401.1 | GAUAACCUUGACUACUAAAAU | 2984 | 2110-2130 | AUUUAGUAGUCAAGGUUAUCAU | 3164 | 2108-2130 |
| AD-1193402.1 | GAUAACCUUGACUACUAAAAU | 2985 | 2110-2130 | AUUUAGUAGUCAAGGUUAUCGU | 3165 | 2108-2130 |
| AD-1193403.1 | GAUAACCUUGACUACUAAAAU | 2986 | 2110-2130 | AUUUAGUAGUCAAGGUUAUCGU | 3166 | 2108-2130 |
| AD-1193404.1 | GAUAACCUUGACUACUAAAAU | 2987 | 2110-2130 | AUUUAGUAGUCAAGGUUAUCGU | 3167 | 2108-2130 |
| AD-1193405.1 | UAACCUUGACUACUAAAAU | 2988 | 2112-2130 | AUUUAGUAGUCAAGGUUAUC | 3168 | 2110-2130 |

TABLE 49-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
| --- | --- | --- | --- | --- | --- | --- |
| AD-1193406.1 | UAACCUUGACUACUAAAAU | 2989 | 2112-2130 | AUUUUAGUAGUCAAGGUUAUC | 3169 | 2110-2130 |
| AD-1193407.1 | UAACCUUGACUACUAAAAU | 2990 | 2112-2130 | AUUUUAGUAGUCAAGGUUAUC | 3170 | 2110-2130 |
| AD-520053.5 | UUUUAGAACACCUUUUUCACU | 2991 | 2171-2191 | AGUGAAAAGGUGUUCUAAAAUU | 3171 | 2169-2191 |
| AD-1193408.1 | UUUUAGAACACCUUUUUCACU | 2992 | 2171-2191 | AGUGAAAAGGUGUUCUAAAAUU | 3172 | 2169-2191 |
| AD-1193409.1 | UUUUAGAACACCUUUUUCACU | 2993 | 2171-2191 | AGUGAAAAGGUGUUCUAAAAUU | 3173 | 2169-2191 |
| AD-1193410.1 | UUUUAGAACACCUUUUUCACU | 2994 | 2171-2191 | AGUGAAAAGGTGUUCUAAAAUU | 3174 | 2169-2191 |
| AD-1193411.1 | UUUUAGAACACCUUUUUCACU | 2995 | 2171-2191 | AGUGAAAAGGUGUUCUAAAACC | 3175 | 2169-2191 |
| AD-1193412.1 | UUUUAGAACACCUUUUUCACU | 2996 | 2171-2191 | AGUGAAAAGGUGUUCUAAAACC | 3176 | 2169-2191 |
| AD-1193413.1 | UUUUAGAACACCUUUUUCACU | 2997 | 2171-2191 | AGUGAAAAGGTGUUCUAAAACC | 3177 | 2169-2191 |
| AD-1193414.1 | UUUUAGAACACCUUUUUCACU | 2998 | 2171-2191 | AGUGAAAAGGUGUUCUAAAAUU | 3178 | 2169-2191 |
| AD-1193415.1 | UUUUAGAACACCUUUUUCACU | 2999 | 2171-2191 | AGUGAAAAGGUGUUCUAAAAUU | 3179 | 2169-2191 |
| AD-1193416.1 | UUUUAGAACACCUUUUUCACU | 3000 | 2171-2191 | AGUGAAAAGGUGUUCUAAAAUU | 3180 | 2169-2191 |
| AD-1193417.1 | UUUUAGAACACCUUUUUCACU | 3001 | 2171-2191 | AGUGAAAAGGTGUUCUAAAAUU | 3181 | 2169-2191 |
| AD-1193418.1 | UUUUAGAACACCUUUUUCACU | 3002 | 2171-2191 | AGUGAAAAGGUGUUCUAAAAUU | 3182 | 2169-2191 |
| AD-1193419.1 | UUUUAGAACACCUUUUUCACU | 3003 | 2171-2191 | AGUGAAAAGGUGUUCUAAAAUU | 3183 | 2169-2191 |
| AD-1193420.1 | UUUUAGAACACCUUUUUCACU | 3004 | 2171-2191 | AGUGAAAAGGUGUUCUAAAAUU | 3184 | 2169-2191 |
| AD-1193421.1 | UUUUAGAACACCUUUUUCACU | 3005 | 2171-2191 | AGUGAAAAGGTGUUCUAAAAUU | 3185 | 2169-2191 |
| AD-1193422.1 | GUGGAAUCUGCCAUUGCGA | 3006 | 1257-1275 | UCGCAATGGCAGAUUCCACAG | 3186 | 1255-1275 |
| AD-1193423.1 | GUGGAAUCUGCCAUUGCGA | 3007 | 1257-1275 | UCGCAATGGCAGAUUCCACGG | 3187 | 1255-1275 |
| AD-1193424.1 | UGGAAUCUGCCAUUGCGAU | 3008 | 1258-1276 | AUCGCAAUGGCAGAUUCCACA | 3188 | 1256-1276 |
| AD-1193425.1 | UGGAAUCUGCCAUUGCGAU | 3009 | 1258-1276 | AUCGCAAUGGCAGAUUCCACG | 3189 | 1256-1276 |
| AD-1193426.1 | GGAAUCUGCCAUUGCGAUU | 3010 | 1259-1277 | AAUCGCAAUGGCAGAUUCCAC | 3190 | 1257-1277 |
| AD-1193427.1 | GGAAUCUGCCAUUGCGAUU | 3011 | 1259-1277 | AAUCGCAAUGGCAGAUUCCGC | 3191 | 1257-1277 |
| AD-1193428.1 | GAAUCUGCCAUUGCGAUUU | 3012 | 1260-1278 | AAAUCGCAAUGGCAGAUUCCA | 3192 | 1258-1278 |
| AD-1193429.1 | GAAUCUGCCAUUGCGAUUU | 3013 | 1260-1278 | AAAUCGCAAUGGCAGAUUCCG | 3193 | 1258-1278 |
| AD-1193430.1 | AAUCUGCCAUUGCGAUUGU | 3014 | 1261-1279 | ACAATCGCAAUGGCAGAUUCC | 3194 | 1259-1279 |
| AD-1193431.1 | AAUCUGCCAUUGCGAUUGU | 3015 | 1261-1279 | ACAATCGCAAUGGCAGAUUCC | 3195 | 1259-1279 |
| AD-1193432.1 | AUCUGCCAUUGCGAUUGUU | 3016 | 1262-1280 | AACAAUCGCAAUGGCAGAUUC | 3196 | 1260-1280 |
| AD-1193433.1 | AUCUGCCAUUGCGAUUGUU | 3017 | 1262-1280 | AACAAUCGCAATGGCAGAUUC | 3197 | 1260-1280 |
| AD-1193434.1 | UCUGCCAUUGCGAUUGUCU | 3018 | 1263-1281 | AGACAAUCGCAAUGGCAGAUU | 3198 | 1261-1281 |
| AD-1193435.1 | UCUGCCAUUGCGAUUGUCU | 3019 | 1263-1281 | AGACAAUCGCAAUGGCAGAUU | 3199 | 1261-1281 |
| AD-1193436.1 | CUGCCAUUGCGAUUGUCCA | 3020 | 1264-1282 | UGGACAAUCGCAAUGGCAGAU | 3200 | 1262-1282 |
| AD-1193437.1 | CUGCCAUUGCGAUUGUCCA | 3021 | 1264-1282 | UGGACAAUCGCAAUGGCAGAU | 3201 | 1262-1282 |
| AD-1193438.1 | UGCCAUUGCGAUUGUCCAU | 3022 | 1265-1283 | AUGGACAAUCGCAAUGGCAGA | 3202 | 1263-1283 |
| AD-1193439.1 | UGCCAUUGCGAUUGUCCAU | 3023 | 1265-1283 | AUGGACAAUCGCAAUGGCAGG | 3203 | 1263-1283 |
| AD-1193440.1 | GCCAUUGCGAUUGUCCAGA | 3024 | 1266-1284 | UCUGGACAAUCGCAAUGGCGG | 3204 | 1264-1284 |
| AD-805631.3 | CCAUUGCGAUUGUCCAGAU | 3025 | 1267-1285 | AUCUGGACAAUCGCAAUGG | 3205 | 1267-1285 |

TABLE 49-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
|---|---|---|---|---|---|---|
| AD-1193441.1 | CCAUUGCGAUUGUCCAGAU | 3026 | 1267-1285 | AUCUGGACAAUCGCAAUGG | 3206 | 1267-1285 |
| AD-1193442.1 | CCAUUGCGAUUGUCCAGAU | 3027 | 1267-1285 | AUCUGGACAAUCGCAAUGGCA | 3207 | 1265-1285 |
| AD-1193443.1 | CCAUUGCGAUUGUCCAGAU | 3028 | 1267-1285 | AUCUGGACAAUCGCAAUGGCG | 3208 | 1265-1285 |
| AD-1193444.1 | CAUUGCGAUUGUCCAGAGA | 3029 | 1268-1286 | UCUCTGGACAAUCGCAAUGGC | 3209 | 1266-1286 |
| AD-1193445.1 | AUUGCGAUUGUCCAGAGAU | 3030 | 1269-1287 | AUCUCUGGACAAUCGCAAUGG | 3210 | 1267-1287 |
| AD-1193446.1 | CAUUGCGAUUGUCCAGAGACU | 3031 | 1268-1288 | AGUCTCTGGACAAUCGCAAUGGC | 3211 | 1266-1288 |
| AD-1193447.1 | UGCGAUUGUCCAGAGACUU | 3032 | 1271-1289 | AAGUCUCUGGACAAUCGCAGU | 3212 | 1269-1289 |
| AD-1193448.1 | GCGAUUGUCCAGAGACUGU | 3033 | 1272-1290 | ACAGTCTCGGACAAUCGCAA | 3213 | 1270-1290 |
| AD-1193449.1 | UUGCGAUUGUCCAGAGACUGU | 3034 | 1270-1290 | ACAGTCTCGGACAAUCGCAAUG | 3214 | 1268-1290 |
| AD-1193450.1 | CGAUUGUCCAGAGACUGGU | 3035 | 1273-1291 | ACCAGUCUCUGGACAAUCGCA | 3215 | 1271-1291 |
| AD-1193451.1 | CGAUUGUCCAGAGACUGGU | 3036 | 1273-1291 | ACCAGUCUCUGGACAAUCGCG | 3216 | 1271-1291 |
| AD-1193452.1 | GAUUGUCCAGAGACUGGUU | 3037 | 1274-1292 | AACCAGTCUCUGGACAAUCGC | 3217 | 1272-1292 |
| AD-1193452.2 | GAUUGUCCAGAGACUGGUU | 3038 | 1274-1292 | AACCAGTCUCUGGACAAUCGC | 3218 | 1272-1292 |
| AD-1193453.1 | AUUGUCCAGAGACUGGUGA | 3039 | 1275-1293 | UCACCAGUCUCUGGACAAUCG | 3219 | 1273-1293 |
| AD-1193454.1 | AUUGUCCAGAGACUGGUGA | 3040 | 1275-1293 | UCACCAGUCUCUGGACAAUCG | 3220 | 1273-1293 |
| AD-1193455.1 | UUGUCCAGAGACUGGUGAU | 3041 | 1276-1294 | AUCACCAGUCUCUGGACAAUC | 3221 | 1274-1294 |
| AD-1193456.1 | UUGUCCAGAGACUGGUGAU | 3042 | 1276-1294 | AUCACCAGUCUCUGGACAAUC | 3222 | 1274-1294 |
| AD-1193457.1 | UGUCCAGAGACUGGUGACA | 3043 | 1277-1295 | UGUCACCAGUCUCUGGACAGU | 3223 | 1275-1295 |
| AD-1193458.1 | UGGUUUUAUGAAAAGCUAGGA | 3044 | 1752-1772 | UCCUAGCUUUUCAUAAAACCAAC | 3224 | 1750-1772 |
| AD-1193459.1 | UGGUUUUAUGAAAAGCUAGGA | 3045 | 1752-1772 | UCCUAGCUUUUCAUAAAACCAGC | 3225 | 1750-1772 |
| AD-1193460.1 | GGUUUUAUGAAAAGCUAGGAA | 3046 | 1753-1773 | UUCCTAGCUUUUCAUAAAACCGG | 3226 | 1751-1773 |
| AD-1193461.1 | GUUUUAUGAAAAGCUAGGAAU | 3047 | 1754-1774 | AUUCCUAGCUUUUCAUAAAACCA | 3227 | 1752-1774 |
| AD-1193462.1 | GUUUUAUGAAAAGCUAGGAAU | 3048 | 1754-1774 | AUUCCUAGCUUUUCAUAAAACCG | 3228 | 1752-1774 |
| AD-1193463.1 | UUUUAUGAAAAGCUAGGAAGU | 3049 | 1755-1775 | ACUUCCUAGCUUUUCAUAAAACC | 3229 | 1753-1775 |
| AD-1193464.1 | UUUAUGAAAAGCUAGGAAGCA | 3050 | 1756-1776 | UGCUTCCUAGCUUUUCAUAAAGC | 3230 | 1754-1776 |
| AD-1193465.1 | UUAUGAAAAGCUAGGAAGCAA | 3051 | 1757-1777 | UUGCUUCCUAGCUUUUCAUAAGG | 3231 | 1755-1777 |
| AD-1193466.1 | UAUGAAAAGCUAGGAAGCAAU | 3052 | 1758-1778 | AUUGCUCCUAGCUUUUCAUAGG | 3232 | 1756-1778 |
| AD-1193467.1 | AUGAAAAGCUAGGAAGCAACU | 3053 | 1759-1779 | AGUUGCUCCUAGCUUUUCAUGG | 3233 | 1757-1779 |
| AD-1193468.1 | UGAAAAGCUAGGAAGCAACCU | 3054 | 1760-1780 | AGGUTGCUUCCTAGCUUUUCAUG | 3234 | 1758-1780 |
| AD-1193469.1 | GAAAAGCUAGGAAGCAACCUU | 3055 | 1761-1781 | AAGGUUGCUUCCUAGCUUUUCGU | 3235 | 1759-1781 |
| AD-519773.3 | AAAAGCUAGGAAGCAACCUUU | 3056 | 1762-1782 | AAAGGUUGCUUCCUAGCUUUUCA | 3236 | 1760-1782 |
| AD-1193470.1 | AAAAGCUAGGAAGCAACCUUU | 3057 | 1762-1782 | AAAGGUTGCUUCCUAGCUUUUCA | 3237 | 1760-1782 |
| AD-1193471.1 | AAAAGCUAGGAAGCAACCUUU | 3058 | 1762-1782 | AAAGGUTGCUUCCUAGCUUUUCG | 3238 | 1760-1782 |
| AD-1193472.1 | AAAGCUAGGAAGCAACCUUUU | 3059 | 1763-1783 | AAAAGGUTGCUUCCUAGCUUUUC | 3239 | 1761-1783 |
| AD-1193473.1 | AAGCUAGGAAGCAACCUUUCU | 3060 | 1764-1784 | AGAAAGGUTUGCUUCCUAGCUUUU | 3240 | 1762-1784 |
| AD-1193474.1 | AGCUAGGAAGCAACCUUUCGU | 3061 | 1765-1785 | ACGAAAGGUTUGCUUCCUAGCUUU | 3241 | 1763-1785 |
| AD-1193475.1 | CUAGGAAGCAACCUUUCGU | 3062 | 1767-1785 | ACGAAAGGUUGCUUCCUAGCU | 3242 | 1765-1785 |

TABLE 49-continued

Unmodified Sense and Antisense Strand Sequences of PNPLA3 dsRNA Agents

| Duplex Name | Sense Sequence 5' to 3' | SEQ ID NO: | Range in NM_025225.2 | Antisense Sequence 5' to 3' | SEQ ID NO: | Range in NM_025225.2 |
| --- | --- | --- | --- | --- | --- | --- |
| AD-1193476.1 | GCUAGGAAGCAACCUUUCGCU | 3063 | 1766-1786 | AGCGAAAGGUUGCUUCCUAGCUU | 3243 | 1764-1786 |
| AD-1193477.1 | UAGGAAGCAACCUUUCGCU | 3064 | 1768-1786 | AGCGAAAGGUUGCUUCCUAGC | 3244 | 1766-1786 |
| AD-1193478.1 | CUAGGAAGCAACCUUUCGCCU | 3065 | 1767-1787 | AGGCGAAAGGUUGCUUCCUAGCU | 3245 | 1765-1787 |
| AD-1193479.1 | AGGAAGCAACCUUUCGCCU | 3066 | 1769-1787 | AGGCGAAAGGUUGCUUCCUGG | 3246 | 1767-1787 |
| AD-1193480.1 | UAGGAAGCAACCUUUCGCCUU | 3067 | 1768-1788 | AAGGCGAAAGGUUGCUUCCUAGC | 3247 | 1766-1788 |
| AD-1193481.1 | GGAAGCAACCUUUCGCCUU | 3068 | 1770-1788 | AAGGCGAAAGGTUGCUUCCUG | 3248 | 1768-1788 |
| AD-1193482.1 | AGGAAGCAACCUUUCGCCUGU | 3069 | 1769-1789 | ACAGGCGAAAGGUUGCUUCCUAG | 3249 | 1767-1789 |
| AD-1193483.1 | GAAGCAACCUUUCGCCUGU | 3070 | 1771-1789 | ACAGGCGAAAGGUUGCUUCCU | 3250 | 1769-1789 |
| AD-1193484.1 | AAGCAACCUUUCGCCUGUU | 3071 | 1772-1790 | AACAGGCGAAAGGUUGCUUCC | 3251 | 1770-1790 |
| AD-1193485.1 | AGCAACCUUUCGCCUGUGU | 3072 | 1773-1791 | ACACAGGCGAAAGGUUGCUUC | 3252 | 1771-1791 |
| AD-1193486.1 | GCAACCUUUCGCCUGUGCA | 3073 | 1774-1792 | UGCACAGGCGAAAGGUUGCUU | 3253 | 1772-1792 |

TABLE 50

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-67554.9 | uscsugagCfuGfAfGfuugguuuuauL96 | 3254 | asUfsaaaAfcCfAfacucAfgCfucagasgsg | 3434 | CCUCUGAGCUGAGUUGGUUUUAU | 3614 |
| AD-1193317.1 | uscsugagCfuGfAfGfuugguuuuauL96 | 3255 | asUfsaadAadCcaacucAfgCfucagasgsg | 3435 | CCUCUGAGCUGAGUUGGUUUUAU | 3615 |
| AD-1193318.1 | uscsugagCfuGfAfGfuugguuuuauL96 | 3256 | asdTsaadAadCcaacdTcdAgdCucagasgsg | 3436 | CCUCUGAGCUGAGUUGGUUUUAU | 3616 |
| AD-1193319.1 | uscsugagCfuGfAfGfuugguuuuauL96 | 3257 | asdTsaadAadCcaacucAfgCfucagasgsc | 3437 | CCUCUGAGCUGAGUUGGUUUUAU | 3617 |
| AD-1193320.1 | uscsugagCfuGfAfGfuugguuuuauL96 | 3258 | asdTsaadAadCcaacucAfgCfucagascsc | 3438 | CCUCUGAGCUGAGUUGGUUUUAU | 3618 |
| AD-1193321.1 | usgsagCfuGfAfGfuugguuuuauL96 | 3259 | asUfsaadAadCcaacucAfgCfucasgsc | 3439 | UCUCUGAGCUGAGUUGGUUUUAU | 3619 |
| AD-1193322.1 | usgsagCfuGfAfGfuugguuuuauL96 | 3260 | asdTsaadAadCcaacdTcdAgdCucasgsc | 3440 | UCUGAGCUGAGUUGGUUUUAU | 3620 |
| AD-1193323.1 | uscsugagCfudGadGuuguuuuauL96 | 3261 | asUfsaaaAfcCfAfacucAfgCfucagasgsg | 3441 | CCUCUGAGCUGAGUUGGUUUUAU | 3621 |
| AD-1193324.1 | uscsugagCfugaAfdGuuguuuuauL96 | 3262 | asUfsaaaAfcCfAfacucAfgCfucagasgsg | 3442 | CCUCUGAGCUGAGUUGGUUUUAU | 3622 |
| AD-1193325.1 | uscsugagCfugaAfdGuuguuuuauL96 | 3263 | asUfsaaaAfcCfAfacucAfgCfucagasgsc | 3443 | CCUCUGAGCUGAGUUGGUUUUAU | 3623 |
| AD-1193326.1 | uscsugagCfudGadGuuguuuuauL96 | 3264 | asUfsaadAadCcaacucAfgCfucagasgsg | 3444 | CCUCUGAGCUGAGUUGGUUUUAU | 3624 |
| AD-1193327.1 | uscsugagCfugAfdGuuguuuuauL96 | 3265 | asUfsaadAadCcaacucAfgCfucagasgsg | 3445 | CCUCUGAGCUGAGUUGGUUUUAU | 3625 |
| AD-1193328.1 | uscsugagCfugadGUfugguuuuauL96 | 3266 | asUfsaadAadCcaacucAfgCfucagasgsg | 3446 | CCUCUGAGCUGAGUUGGUUUUAU | 3626 |
| AD-1193329.1 | uscsugagCfudGadGuuguuuuauL96 | 3267 | asUfsaadAadCcaacucAfgCfucagasgsc | 3447 | CCUCUGAGCUGAGUUGGUUUUAU | 3627 |
| AD-1193330.1 | uscsugagCfugaAfdGuuguuuuauL96 | 3268 | asUfsaadAadCcaacucAfgCfucagasgsc | 3448 | CCUCUGAGCUGAGUUGGUUUUAU | 3628 |
| AD-1193331.1 | uscsugagCfugadGUfugguuuuauL96 | 3269 | asUfsaadAadCcaacucAfgCfucagascsc | 3449 | CCUCUGAGCUGAGUUGGUUUUAU | 3629 |
| AD-1193332.1 | usgsagCfudGadGuuguuuuauL96 | 3270 | asUfsaadAadCcaacucAfgCfucasgsc | 3450 | UCUGAGCUGAGUUGGUUUUAU | 3630 |
| AD-1193333.1 | usgsagCfugAfdGuuguuuuauL96 | 3271 | asUfsaadAadCcaacucAfgCfucasgsc | 3451 | UCUGAGCUGAGUUGGUUUUAU | 3631 |
| AD-1193334.1 | usgsagCfugadGUfugguuuuauL96 | 3272 | asUfsaadAadCcaacucAfgCfucasgsc | 3452 | UCUGAGCUGAGUUGGUUUUAU | 3632 |
| AD-1193335.1 | uscsugagcudGadGuuguuuuauL96 | 3273 | asdTsaadAadCcaacdTcdAgdCucagasgsg | 3453 | CCUCUGAGCUGAGUUGGUUUUAU | 3633 |
| AD-1193336.1 | uscsugagcudGadGuuggudTuuauL96 | 3274 | asdTsaadAadCcaacdTcdAgdCucagasgsg | 3454 | CCUCUGAGCUGAGUUGGUUUUAU | 3634 |
| AD-519346.3 | cscsauuaGfgAfUfAfaugucuuauuL96 | 3275 | asAfsuaaGfaCfAfuuaauCfcUfaauggsgsu | 3455 | ACCCAUUAGGAUAAUGUCUUAUG | 3635 |
| AD-1193337.1 | cscsauuaGfaAfUfAfaugucuuauuL96 | 3276 | asAfsuadAgdAcauuauCfcUfaauggsgsu | 3456 | ACCCAUUAGGAUAAUGUCUUAUG | 3636 |
| AD-1193338.1 | cscsauuaGfaAfUfAfaugucuuauuL96 | 3277 | asdAsuadAgdAcauuauCfcUfaauggsgsu | 3457 | ACCCAUUAGGAUAAUGUCUUAUG | 3637 |

TABLE 50-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1193339.1 | cscsauuaGfgAfUfAfaugucuuauuL96 | 3278 | asAfsuaAgdAcauuauCfcUfaauggscsc | 3458 | ACCCAUUAGGAUAAUGUCUUAUG | 3638 |
| AD-1193340.1 | cscsauuaGfgAfUfAfaugucuauuuL96 | 3279 | asdAsuaAgdAcauuauCfcUfaauggscsc | 3459 | ACCCAUUAGGAUAAUGUCUUAUG | 3639 |
| AD-1193341.1 | cscsauuaggAfUfUfAfaugucuuauuL96 | 3280 | asAfsuaAgdAgdAcauuauCfcUfaauggscsc | 3460 | ACCCAUUAGGAUAAUGUCUUAUG | 3640 |
| AD-1193342.1 | cscsauuaggAfUfUfAfaugucuuauuL96 | 3281 | asdAsuaAgdAgdAcauuauCfcUfaauggsgsu | 3461 | ACCCAUUAGGAUAAUGUCUUAUG | 3641 |
| AD-1193343.1 | cscsauuaggAfUfUfAfaugucuuauuL96 | 3282 | asAfsuaAgdAgdAcauuauCfcUfaauggsgsc | 3462 | ACCCAUUAGGAUAAUGUCUUAUG | 3642 |
| AD-1193344.1 | cscsauuaggAfUfUfAfaugucuuauuL96 | 3283 | asdAsuaAgdAcauuauCfcUfaauggscsc | 3463 | ACCCAUUAGGAUAAUGUCUUAUG | 3643 |
| AD-1193345.1 | asusuaggAfUfAfaugucuuauuL96 | 3284 | asAfsuaAgdAgdAcauuauCfcUfaauggsg | 3464 | CCAUUAGGAUAAUGUCUUAUG | 3644 |
| AD-1193346.1 | asusuaggAfUfUfAfaugucuuauuL96 | 3285 | asdAsuaAgdAcauuauCfcUfaauggsg | 3465 | CCAUUAGGAUAAUGUCUUAUG | 3645 |
| AD-1193347.1 | cscsauuaggdAudAaugucuuauuL96 | 3286 | asAfsuadAgdAcauuauCfcUfaauggsgsu | 3466 | ACCCAUUAGGAUAAUGUCUUAUG | 3646 |
| AD-1193348.1 | cscsauuaggdAudAaugucuuauuL96 | 3287 | asdAsuadAgdAcauuauCfcUfaauggsgsu | 3467 | ACCCAUUAGGAUAAUGUCUUAUG | 3647 |
| AD-1193349.1 | cscsauuaggdAudAaugucuuauuL96 | 3288 | asdAsuadAgdAcauuauCfcUfaauggsgsu | 3468 | ACCCAUUAGGAUAAUGUCUUAUG | 3648 |
| AD-519347.4 | csasuuaagGfaUfAfAfugucuuaugUL96 | 3289 | asCfsauaAfgAfcTfauuaUfcCfuaaugsgsg | 3469 | CCAUUAGGAUAAUGUCUUAUGU | 3649 |
| AD-1193350.1 | csasuuaagGfaUfAfAfugucuuaugUL96 | 3290 | asCfsaudAadGacauuaUfcCfuaaugsgsg | 3470 | CCAUUAGGAUAAUGUCUUAUGU | 3650 |
| AD-1193351.1 | csasuuaagGfaUfAfAfugucuuaugUL96 | 3291 | asCfsaudAadGacauuaUfcCfuaaugscsc | 3471 | CCAUUAGGAUAAUGUCUUAUGU | 3651 |
| AD-1193352.1 | csasuuaaggaUfAfAfugucuuaugUL96 | 3292 | asCfsaudAadGacauuaUfcCfuaaugsgsg | 3472 | CCAUUAGGAUAAUGUCUUAUGU | 3652 |
| AD-1193353.1 | csasuuaaggaUfAfAfugucuuaugUL96 | 3293 | asCfsaudAadGacauuaUfcCfuaaugsgsg | 3473 | CCAUUAGGAUAAUGUCUUAUGU | 3653 |
| AD-1193354.1 | ususuaggaUfAfAfugucuuaugUL96 | 3294 | asCfsaudAadGacauuaUfcCfuaasusg | 3474 | CAUUAGGAUAAUGUCUUAUGU | 3654 |
| AD-1193355.1 | csasuuaggadTadAugucudTaugucUL96 | 3295 | asCfsaudAadGacauuaUfcCfuaaugsgsg | 3475 | CCCAUUAGGAUAAUGUCUUAUGU | 3655 |
| AD-1193356.1 | csasuuaggadTadAugucudTaugucUL96 | 3296 | asCfsaudAadGacauuaUfcCfuaaugsgsg | 3476 | CCCAUUAGGAUAAUGUCUUAUGU | 3656 |
| AD-1193357.1 | csasuuaggadAudAUfgucuuaugUL96 | 3297 | asCfsaudAadGacauuaUfcCfuaaugsgsg | 3477 | CCCAUUAGGAUAAUGUCUUAUGU | 3657 |
| AD-1193358.1 | csasuuaggadAudAUfgucudTaugucUL96 | 3298 | asCfsaudAadGacauuaUfcCfuaaugsgsg | 3478 | CCCAUUAGGAUAAUGUCUUAUGU | 3658 |
| AD-519350.4 | usUfgUfGfUfcuuauguaauL96 | 3299 | asUfsuacAfuAfAfgacaUfuAfuccuasasu | 3479 | CCCAUUAGGAUAAUGUCUUAUAU | 3659 |
| AD-1193359.1 | usasgggauAfaUfGfUfcuuauguaauL96 | 3300 | asUfsuacCadTaagacaUfuAfuccuasasu | 3480 | AUUAGGAUAAUGUCUUAUGUAAU | 3660 |
| AD-1193360.1 | usasgggauAfaUfGfUfcuuauguaauL96 | 3301 | asUfsuacCadTaagacaUfuAfuccuasasu | 3481 | AUUAGGAUAAUGUCUUAUGUAAU | 3661 |
| AD-1193361.1 | usasgggauAfaUfGfUfcuuauguaauL96 | 3302 | asUfsuacCadTaagacaUfuAfuccuasgsu | 3482 | AUUAGGAUAAUGUCUUAUGUAAU | 3662 |

TABLE 50-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1193362.1 | usasggauAfaUfGfGfUfcuuauguaauL96 | 3303 | asUfsuadCadTaagacaUfudAuccuasgsu | 3483 | AUUAGGAUAAUGUCUUAUGUAAU | 3663 |
| AD-1193363.1 | usasggauAfaUfGfGfUfcuuauguaauL96 | 3304 | asUfsuadCadTaagacaUfuAfuccuascsc | 3484 | AUUAGGAUAAUGUCUUAUGUAAU | 3664 |
| AD-1193364.1 | usasggauAfaUfGfGfUfcuuauguaauL96 | 3305 | asUfsuadCadTaagacaUfuAfuccuaauL96 | 3485 | AUUAGGAUAAUGUCUUAUGUAAU | 3665 |
| AD-1193365.1 | usasggauaaUfgUfcuuauguaauL96 | 3306 | asUfsuadCadTaagacaUfuAfuccuasgsu | 3486 | AUUAGGAUAAUGUCUUAUGUAAU | 3666 |
| AD-1193366.1 | usasggauaaUfgUfcuuauguaauL96 | 3307 | asUfsuadCadTaagacaUfuAfuccuasgsu | 3487 | AUUAGGAUAAUGUCUUAUGUAAU | 3667 |
| AD-1193367.1 | usasggauaaUfgUfcuuauguaauL96 | 3308 | asUfsuadCadTaagadCaUfAfuccuasgsu | 3488 | AUUAGGAUAAUGUCUUAUGUAAU | 3668 |
| AD-1193368.1 | usasggauaaUfgUfcuuauguaauL96 | 3309 | asUfsuadCadTaagadCaUfudAuccuasgsu | 3489 | AUUAGGAUAAUGUCUUAUGUAAU | 3669 |
| AD-1193369.1 | usasggauaaUfgUfCfuuauguaauL96 | 3310 | asUfsuadCadTaagadCaUfuAfuccuasgsu | 3490 | AUUAGGAUAAUGUCUUAUGUAAU | 3670 |
| AD-1193370.1 | usasggauaaUfgUfCfuuauguaauL96 | 3311 | asUfsuadCadTaagadCaUfuAfuccuasgsu | 3491 | AUUAGGAUAAUGUCUUAUGUAAU | 3671 |
| AD-1193371.1 | usasggauaUfgUfcUfuuauguaauL96 | 3312 | asUfsuadCadTaagadCaUfuAfuccuasgsu | 3492 | AUUAGGAUAAUGUCUUAUGUAAU | 3672 |
| AD-1193372.1 | usasggauaUfgUfCfuuauguaauL96 | 3313 | asUfsuadCadTaagadCaUfudAuccuasgsu | 3493 | AUUAGGAUAAUGUCUUAUGUAAU | 3673 |
| AD-519757.4 | csusgagUfgGfUfGfUfUfuuaugaaaaaL96 | 3314 | asUfsuuuCfaUfAfaaacCfaAfcucagscsu | 3494 | AGCUGAGUUGGUUUUAUGAAAAG | 3674 |
| AD-1193373.1 | csusgagUfgGfUfGfUfUfuuaugaaaaaL96 | 3315 | asUfsuudTc(Agn)uaaaacCfadAcucagscsu | 3495 | AGCUGAGUUGGUUUUAUGAAAAG | 3675 |
| AD-1193374.1 | csusgagUfgGfUfGfUfUfuuaugaaaaaL96 | 3316 | asUfsuudTc(Agn)uaaaacCfadAcucagscsu | 3496 | AGCUGAGUUGGUUUUAUGAAAAG | 3676 |
| AD-1193375.1 | csusgagUfgGfUfGfUfUfuuaugaaaaaL96 | 3317 | asUfsuudTc(A2p)uaaaacCfaAfcucagsusc | 3497 | AGCUGAGUUGGUUUUAUGAAAAG | 3677 |
| AD-1193376.1 | csusgagUfgGfUfGfUfUfuuaugaaaaaL96 | 3318 | asUfsuudTc(A2p)uaaaacCfadAcucagsusc | 3498 | AGCUGAGUUGGUUUUAUGAAAAG | 3678 |
| AD-1193377.1 | csusgagUfgGfUfgUfUfuuaugaaaaaL96 | 3319 | asUfsuudTc(Agn)uaaaacCfadAcucagscsu | 3499 | AGCUGAGUUGGUUUUAUGAAAAG | 3679 |
| AD-1193378.1 | csusgagUfggUfUfGfUfuuaugaaaaaL96 | 3320 | asUfsuudTc(Agn)uaaaacCfadAcucagscsu | 3500 | AGCUGAGUUGGUUUUAUGAAAAG | 3680 |
| AD-1193379.1 | csusgagUfggUfgUfUfuuaugaaaaaL96 | 3321 | asUfsuudTc(Agn)uaaaacCfadAcucagscsu | 3501 | AGCUGAGUUGGUUUUAUGAAAAG | 3681 |
| AD-1193380.1 | csusgagUfggUfgUfUfuuaugaaaaaL96 | 3322 | asUfsuudTc(A2p)uaaaacCfaAfcucagsusc | 3502 | AGCUGAGUUGGUUUUAUGAAAAG | 3682 |
| AD-1193381.1 | csusgagUfggUfgUfUfuuaugaaaaaL96 | 3323 | asUfsuudTc(Agn)uaaaacCfadAcucagscsu | 3503 | AGCUGAGUUGGUUUUAUGAAAAG | 3683 |
| AD-1193382.1 | csusgagUfggUfgUfUfuuaugaaaaaL96 | 3324 | asUfsuudTc(Agn)uaaaacCfadAcucagsusc | 3504 | AGCUGAGUUGGUUUUAUGAAAAG | 3684 |
| AD-1193383.1 | gsasguUfggUfUfUfUfuuaugaaaaaL96 | 3325 | asUfsuudTc(Agn)uaaaacCfaAfcucsgsg | 3505 | CUGAGUUGGUUUUAUGAAAAG | 3685 |
| AD-1193384.1 | gsasguUfggUfUfUfUfuuaugaaaaaL96 | 3326 | asUfsuudTc(Agn)uaaaacCfaAfcucsgsg | 3506 | CUGAGUUGGUUUUAUGAAAAG | 3686 |
| AD-1193385.1 | csusgagUfgGfUfUfUfuuaugaaaaaL96 | 3327 | asUfsuudTc(Agn)uaaaacCfaAfcucsgsg | 3507 | AGCUGAGUUGGUUUUAUGAAAAG | 3687 |

TABLE 50-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1193386.1 | csusgaguUfggUfUfUfuaugaaaauL96 | 3328 | asUfsuudTc(Agn)uaaaacCfadAcucagscsu | 3508 | AGCUGAGUUGGUUUAUGAAAAG | 3688 |
| AD-1193387.1 | csusgaguUfggUfUfUfuaugaaaauL96 | 3329 | asUfsuudTc(A2p)uaaaacCfadAcucagscsu | 3509 | AGCUGAGUUGGUUUAUGAAAAG | 3689 |
| AD-1193388.1 | csusgaguUfggUfUfUfuaugaaaauL96 | 3330 | asUfsuudTc(Agn)uaaaacCfaAfcucagsusc | 3510 | AGCUGAGUUGGUUUAUGAAAAG | 3690 |
| AD-1193389.1 | csusgaguUfggUfUfUfuaugaaaauL96 | 3331 | asUfsuudTc(Agn)uaaaacCfadAcucagsusc | 3511 | AGCUGAGUUGGUUUAUGAAAAG | 3691 |
| AD-1193390.1 | gsasguUfggUfUfUfuaugaaaauL96 | 3332 | asUfsuudTc(Agn)uaaaacCfaAfcucsgsg | 3512 | CUGAGUUGGUUUAUGAAAAG | 3692 |
| AD-1193391.1 | gsasguUfggUfUfUfuaugaaaauL96 | 3333 | asUfsuudTc(Agn)uaaaacCfadAcucsgsg | 3513 | CUGAGUUGGUUUAUGAAAAG | 3693 |
| AD-520018.9 | gsasuaacCfuUfGfAfcuacuaaaauL96 | 3334 | asUfsuuuAfgUfAfgucaAfgGfuuaucsasu | 3514 | AUGAUAACCUUGACUACUAAAAA | 3694 |
| AD-1193392.1 | gsasuaacCfuUfGfAfcuacuaaaauL96 | 3335 | asUfsuudTa(G2p)uagucaAfgGfuuaucsasu | 3515 | AUGAUAACCUUGACUACUAAAAA | 3695 |
| AD-1193393.1 | gsasuaacCfuUfGfAfcuacuaaaauL96 | 3336 | asUfsuudTa(G2p)uagucaAfgdGuuaucsasu | 3516 | AUGAUAACCUUGACUACUAAAAA | 3696 |
| AD-1193394.1 | gsasuaacCfuUfGfAfcuacuaaaauL96 | 3337 | asUfsuudTa(G2p)uagudCaAfgdGuuaucsasu | 3517 | AUGAUAACCUUGACUACUAAAAA | 3697 |
| AD-1193395.1 | gsasuaacCfuUfGfAfcuacuaaaauL96 | 3338 | asUfsuudTa(G2p)uagucaAfgGfuuaucsgsu | 3518 | AUGAUAACCUUGACUACUAAAAA | 3698 |
| AD-1193396.1 | gsasuaacCfuUfGfAfcuacuaaaauL96 | 3339 | asUfsuudTa(G2p)uagucaAfgdGuuaucsgsu | 3519 | AUGAUAACCUUGACUACUAAAAA | 3699 |
| AD-1193397.1 | gsasuaacCfuUfGfAfcuacuaaaauL96 | 3340 | asUfsuudTa(G2p)uagudCaAfgdGuuaucsgsu | 3520 | AUGAUAACCUUGACUACUAAAAA | 3700 |
| AD-1193398.1 | gsasuaacCfuUfGfAfcuacuaaaauL96 | 3341 | asUfsuuuAfgUfAfgucaAfgGfuuaucsasu | 3521 | AUGAUAACCUUGACUACUAAAAA | 3701 |
| AD-1193399.1 | gsasuaacCfuUfGfAfcuacuaaaauL96 | 3342 | asUfsuudTa(G2p)uagucaAfgGfuuaucsasu | 3522 | AUGAUAACCUUGACUACUAAAAA | 3702 |
| AD-1193400.1 | gsasuaacCfuUfGfAfcuacuaaaauL96 | 3343 | asUfsuudTa(G2p)uagucaAfgdGuuaucsasu | 3523 | AUGAUAACCUUGACUACUAAAAA | 3703 |
| AD-1193401.1 | gsasuaacCfuUfGfAfcuacuaaaauL96 | 3344 | asUfsuudTa(G2p)uagudCaAfgdGuuaucsasu | 3524 | AUGAUAACCUUGACUACUAAAAA | 3704 |
| AD-1193402.1 | gsasuaacCfuUfGfAfcuacuaaaauL96 | 3345 | asUfsuudTa(G2p)uagucaAfgGfuuaucsgsu | 3525 | AUGAUAACCUUGACUACUAAAAA | 3705 |
| AD-1193403.1 | gsasuaacCfuUfGfAfcuacuaaaauL96 | 3346 | asUfsuudTa(G2p)uagucaAfgdGuuaucsgsu | 3526 | AUGAUAACCUUGACUACUAAAAA | 3706 |
| AD-1193404.1 | gsasuaacCfuUfGfAfcuacuaaaauL96 | 3347 | asUfsuudTa(G2p)uagudCaAfgdGuuaucsgsu | 3527 | AUGAUAACCUUGACUACUAAAAA | 3707 |
| AD-1193405.1 | usasaccCfuUfgAfcuacuaaauL96 | 3348 | asUfsuudTa(G2p)uagucaAfgGfuuasusc | 3528 | GAUAACCUUGACUACUAAAUC | 3708 |
| AD-1193406.1 | usasaccCfuUfgAfcuacuaaauL96 | 3349 | asUfsuudTa(G2p)uagucaAfgdGuuasusc | 3529 | GAUAACCUUGACUACUAAAUC | 3709 |
| AD-1193407.1 | usasaccCfuUfgAfcuacuaaauL96 | 3350 | asUfsuudTa(G2p)uagudCaAfgdGuuasusc | 3530 | GAUAACCUUGACUACUAAAUC | 3710 |
| AD-520053.5 | ususuuagAfaCfAfCfcuuuuucaccuL96 | 3351 | asGfsugaAfaAfAfgguguUfuCfuaaaasusu | 3531 | AAUUUUAGAACACCUUUUUCAC | 3711 |
| AD-1193408.1 | ususuuagAfaCfAfCfcuuuuucaccuL96 | 3352 | asGfsugdAadAaaggguUfuCfuaaaasusu | 3532 | AAUUUUAGAACACCUUUUUCACC | 3712 |

TABLE 50-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1193409.1 | ususuuagAfaCfAfCfcuuuuucacuL96 | 3353 | asdGsugdAadAaadAaaggugUfuCfuaaaasusu | 3533 | AAUUUUAGAACACCUUUUUCACC | 3713 |
| AD-1193410.1 | ususuuagAfaCfAfCfcuuuuucacuL96 | 3354 | asdGsugdAadAaaggdTgfuCfuaaaasusu | 3534 | AAUUUUAGAACACCUUUUUCACC | 3714 |
| AD-1193411.1 | ususuuagAfaCfAfCfcuuuuucacuL96 | 3355 | asGfsugdAadAaaggugUfuCfuaaaascsc | 3535 | AAUUUUAGAACACCUUUUUCACC | 3715 |
| AD-1193412.1 | ususuuagAfaCfAfCfcuuuuucacuL96 | 3356 | asdGsugdAadAaaggugUfuCfuaaaascsc | 3536 | AAUUUUAGAACACCUUUUUCACC | 3716 |
| AD-1193413.1 | ususuuagAfaCfAfCfcuuuuucacuL96 | 3357 | asdGsugdAadAaaggdTgfuCfuaaaascsc | 3537 | AAUUUUAGAACACCUUUUUCACC | 3717 |
| AD-1193414.1 | ususuuagaaCfaCfcuuuuucacuL96 | 3358 | asGfsugaAfaAfAfgugUfuCfuaaaasusu | 3538 | AAUUUUAGAACACCUUUUUCACC | 3718 |
| AD-1193415.1 | ususuuagaaCfaCfcuuuuucacuL96 | 3359 | asGfsugdAadAaaggugUfuCfuaaaasusu | 3539 | AAUUUUAGAACACCUUUUUCACC | 3719 |
| AD-1193416.1 | ususuuagaaCfaCfcuuuuucacuL96 | 3360 | asdGsugdAadAaaggugUfuCfuaaaasusu | 3540 | AAUUUUAGAACACCUUUUUCACC | 3720 |
| AD-1193417.1 | ususuuagaaCfaCfCfuuuuuucacuL96 | 3361 | asGfsugaAfaAfAfgugUfuCfuuaaaasusu | 3541 | AAUUUUAGAACACCUUUUUCACC | 3721 |
| AD-1193418.1 | ususuuagaaCfaCfCfuuuuuucacuL96 | 3362 | asGfsugaAfaAfAfgugUfuCfuaaaasusu | 3542 | AAUUUUAGAACACCUUUUUCACC | 3722 |
| AD-1193419.1 | ususuuagaaCfaCfCfuuuuuucacuL96 | 3363 | asdGsugdAadAaaggugUfuCfuaaaasusu | 3543 | AAUUUUAGAACACCUUUUUCACC | 3723 |
| AD-1193420.1 | ususuuagaaCfaCfCfuuuuuucacuL96 | 3364 | asdGsugdAadAaadAaaggugUfuCfuaaaasusu | 3544 | AAUUUUAGAACACCUUUUUCACC | 3724 |
| AD-1193421.1 | ususuuagaaCfaCfCfuuuuuucacuL96 | 3365 | asdGsugdAadAaaggdTgfuCfuaaaasusu | 3545 | AAUUUUAGAACACCUUUUUCACC | 3725 |
| AD-1193422.1 | gsusggaaUfCfUfgccauugcgaL96 | 3366 | usCfsgcdAadTgcagaUfuCfcacsasg | 3546 | CUGUGGAAUCUGCCAUUGCGA | 3726 |
| AD-1193423.1 | gsusggaaUfCfUfgccauugcgaL96 | 3367 | usCfsgcdAadTgcagaUfuCfcacsgsg | 3547 | CUGUGGAAUCUGCCAUUGCGA | 3727 |
| AD-1193424.1 | usgsggaauCfUfGfccauugcgauL96 | 3368 | asUfscgdCadAuggcagAfuUfccascsa | 3548 | UGUGGAAUCUGCCAUUGCGAU | 3728 |
| AD-1193425.1 | usgsggaauCfUfgGfccauugcgauL96 | 3369 | asUfscgdCadAuggcagAfuUfccascsg | 3549 | UGUGGAAUCUGCCAUUGCGAU | 3729 |
| AD-1193426.1 | gsgsgaaucUfGfCfcauugcgauuL96 | 3370 | asAfsucdGcdAauggcaGfaUfuccsasc | 3550 | GUGGAAUCUGCCAUUGCGAUU | 3730 |
| AD-1193427.1 | gsgsgaaucUfGfCfcauugcgauuL96 | 3371 | asAfsucdGcdAauggdCadGaUfuccsgsc | 3551 | GUGGAAUCUGCCAUUGCGAUU | 3731 |
| AD-1193428.1 | gsasaucugCfCfCfauugcgauugL96 | 3372 | asAfsaudCgdCaauggCfaGfauucscsa | 3552 | UGGAAUCUGCCAUUGCGAUUG | 3732 |
| AD-1193429.1 | gsasaucugCfCfCfauugcgauugL96 | 3373 | asAfsaudCgdCaauggCfaGfauucscsg | 3553 | UGGAAUCUGCCAUUGCGAUUG | 3733 |
| AD-1193430.1 | asasucugcCfCfAfuugcgauuguL96 | 3374 | asCfsaadTcdCaauggCfaGfauuscsc | 3554 | GGAAUCUGCCAUUGCGAUUGU | 3734 |
| AD-1193431.1 | asasucugcCfCfAfuugcgauuguL96 | 3375 | asCfsaadTcdCaauggCfagauuuscsc | 3555 | GGAAUCUGCCAUUGCGAUUGU | 3735 |
| AD-1193432.1 | asuscugccCfAfUfugcgauuguuL96 | 3376 | asAfscadAudCgcaaugGfcAfgauusuc | 3556 | GAAUCUGCCAUUGCGAUUGUC | 3736 |
| AD-1193433.1 | asuscugccCfAfUfugcgauuguuL96 | 3377 | asAfscadAudCgcaadTgdGcAfgaususc | 3557 | GAAUCUGCCAUUGCGAUUGUC | 3737 |

TABLE 50-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1193434.1 | uscsugccAfUfUfgcgauugucuL96 | 3378 | asGfsacdAadTcgcaaudGfCfagasusu | 3558 | AAUCUGCCAUUGCGAUUGUCC | 3738 |
| AD-1193435.1 | uscsugccAfUfUfgcgauugucuL96 | 3379 | asdGsacdAadTcgcadAudGgCfagasusu | 3559 | AAUCUGCCAUUGCGAUUGUCC | 3739 |
| AD-1193436.1 | csusgccaUfUfGfcgauugucсaL96 | 3380 | usGfsgadCadAucgcaaUfgGfcagsasu | 3560 | AUCUGCCAUUGCGAUUGUCCA | 3740 |
| AD-1193437.1 | csusgccaUfudGfCfgauugucсaL96 | 3381 | usdGsgadCadAucgcaaUfgdGcagsasu | 3561 | AUCUGCCAUUGCGAUUGUCCA | 3741 |
| AD-1193438.1 | usgsccauUfGfCfgauugucсagL96 | 3382 | asUfsggdAcdAucgcAaUfgGfgcasgsa | 3562 | UCUGCCAUUGCGAUUGUCCAG | 3742 |
| AD-1193439.1 | usgsccauUfgCfgauugucсauL96 | 3383 | asUfsggdAcdAaucgdCaAfudGgcasgsg | 3563 | UCUGCCAUUGCGAUUGUCCAG | 3743 |
| AD-1193440.1 | gscscauudGcdGauugucсagaL96 | 3384 | usCfsugdGa(Cgn)aaucgCfaAfUfggcsgsg | 3564 | CUGCCAUUGCGAUUGUCCAGA | 3744 |
| AD-805631.3 | cscsauugCfgAfUfUfguccagauL96 | 3385 | asUfscugGfacaaucgCfaAfugg | 3565 | CCAUUGCGAUUGUCCAGAG | 3745 |
| AD-1193441.1 | cscsauugCfgAfUfUfguccagauL96 | 3386 | asUfscudGg(Agn)caaucgCfaAfusgsg | 3566 | CCAUUGCGAUUGUCCAGAG | 3746 |
| AD-1193442.1 | cscsauugCfgAfUfUfguccagauL96 | 3387 | asUfscudGg(Agn)caaucgCfaAfuggscsa | 3567 | UGCCAUUGCGAUUGUCCAGAG | 3747 |
| AD-1193443.1 | cscsauugCfgAfuugucсagauL96 | 3388 | asUfscudGg(Agn)caaucgCfaAfuggscsg | 3568 | UGCCAUUGCGAUUGUCCAGAG | 3748 |
| AD-1193444.1 | csasuugcAfUfUfUfguccagagaL96 | 3389 | usCfsucdTg(G2p)acaaucdGaAfaugsgsc | 3569 | GCCAUUGCGAUUGUCCAGAGA | 3749 |
| AD-1193445.1 | asusugcgAfUfUfUfguccagagauL96 | 3390 | asUfscudCu(G2p)gacaauUfcdGcaaugsgsg | 3570 | CCAUUGCGAUUGUCCAGAGAC | 3750 |
| AD-1193446.1 | csasuugcgaUfudGUfccagagacuL96 | 3391 | asdGsucdTc(Tgn)ggacaaUfcdGcaaugsgsc | 3571 | GCCAUUGCGAUUGUCCAGAGACU | 3751 |
| AD-1193447.1 | usgsugcgauUfgUfccagagacuuL96 | 3392 | asAfsgudCu(Cgn)uggadCaAfuCfgcasgsu | 3572 | AUUGCGAUUGUCCAGAGACUG | 3752 |
| AD-1193448.1 | gscsgauugUfCfCfagagacugUL96 | 3393 | asCfsagdTcdTcuggacAfaUfcgcsasa | 3573 | UUGCGAUUGUCCAGAGACUGG | 3753 |
| AD-1193449.1 | ususgcgauugUfCfCfagagacuguL96 | 3394 | asCfsagdTcdTcuggacAfaUfcgcaasusg | 3574 | CAUUGCGAUUGUCCAGAGACUGG | 3754 |
| AD-1193450.1 | csgsauugUfCfCfagagacugguL96 | 3395 | asCfscadGudCucuggaCfaAfucgscsa | 3575 | UGCGAUUGUCCAGAGACUGGU | 3755 |
| AD-1193451.1 | csgsauugUfCfCfagagacugguL96 | 3396 | asCfscadGudCucuggaCfaAfucgscsg | 3576 | UGCGAUUGUCCAGAGACUGGU | 3756 |
| AD-1193452.1 | gsasuugcCfCfAfgagacugguuL96 | 3397 | asAfscccAg(Tgn)cucuggAfcAfaucsgsc | 3577 | GCCGAUUGUCCAGAGACUGGUG | 3757 |
| AD-1193452.2 | gsasuugcCfCfAfgagacugguuL96 | 3398 | asAfscccAg(Tgn)cucuggAfcAfaucsgsc | 3578 | GCCGAUUGUCCAGAGACUGGUG | 3758 |
| AD-1193453.1 | asusuguccCfAfGfagacuggugaL96 | 3399 | usCfsacdCadGucucugGfaCfaauscsg | 3579 | CGAUUGUCCAGAGACUGGUGA | 3759 |
| AD-1193454.1 | asusuguccCfadGagacuggugaL96 | 3400 | usCfsacdCadGucucudTgdGaCfaauscsg | 3580 | CGAUUGUCCAGAGACUGGUGA | 3760 |
| AD-1193455.1 | ususuguccAfGfAfgacucuggauL96 | 3401 | asUfscadGc(Agn)gucucuGfaAfcaauscs | 3581 | GAUUGUCCAGAGACUGGUGAC | 3761 |
| AD-1193456.1 | ususuguccAfgAfgacucuggauL96 | 3402 | asUfscadCc(Agn)gucucdCudGAfcaasusc | 3582 | GAUUGUCCAGAGACUGGUGAC | 3762 |

TABLE 50-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1193457.1 | usgsuccadGadGacuggugacaL96 | 3403 | usdGsucdAc(Cgn)agucdTcUfgdGacasgsu | 3583 | AUUGUCCAGAGACUGGUGACA | 3763 |
| AD-1193458.1 | usgsguuuuaUfGfAfaaagcuaggaL96 | 3404 | usCfscudAg(Cgn)uuuucaUfaAfaaccasasc | 3584 | GUUGGUUUUAUGAAAAGCUAGGA | 3764 |
| AD-1193459.1 | usgsguuuuaUfgAfaaagcuaggaL96 | 3405 | usCfscudAg(Cgn)uuuudCaUfaAfaaccasgsc | 3585 | GUUGGUUUUAUGAAAAGCUAGGA | 3765 |
| AD-1193460.1 | gsgsuuuuaugAfAfagcuaggaaL96 | 3406 | usUfsccdTa(G2p)cuuuucAfuaAfaaaccsgsg | 3586 | UUGGUUUUAUGAAAAGCUAGGAA | 3766 |
| AD-1193461.1 | gsusuuuaugAfAfAfagcuaggaauL96 | 3407 | asUfsucdCudAgcuuuuCfaUfaaaaccscsa | 3587 | UGGUUUUAUGAAAAGCUAGGAAG | 3767 |
| AD-1193462.1 | gsusuuuaugAfAfAfagcuaggaauL96 | 3408 | asUfsucdCudAgcuuuuCfaUfaaaacscsg | 3588 | UGGUUUUAUGAAAAGCUAGGAAG | 3768 |
| AD-1193463.1 | ususuuuaugAfAfAfagcuaggaagcaL96 | 3409 | asCfsuudCcdTagcuuuUfcAfuaaaascsc | 3589 | GGUUUUAUGAAAAGCUAGGAAGC | 3769 |
| AD-1193464.1 | usuuuaugaaAfadGCfuaggaagcaaL96 | 3410 | usdGscudTc(Cgn)uagcuuUfucAfauaaasgsc | 3590 | GUUUUAUGAAAAGCUAGGAAGCA | 3770 |
| AD-1193465.1 | ususauugaaaAfgCfuaggaagcaaL96 | 3411 | usUfsgcdTu(Cgn)cuagdCuUfuUfcauaasgsg | 3591 | UUUUAUGAAAAGCUAGGAAGCAA | 3771 |
| AD-1193466.1 | ususugaaaagCfUfUfgaagcaauL96 | 3412 | asUfsugdCu(Tgn)ccuagcUfuUfuucausgsg | 3592 | UUUAUGAAAAGCUAGGAAGCAAC | 3772 |
| AD-1193467.1 | asusgaaaagCfUfAfggaagcaacC96 | 3413 | asdGsuudGc(Tgn)uccuagCfuUfuucasusg | 3593 | UUAUGAAAAGCUAGGAAGCAACC | 3773 |
| AD-1193468.1 | usgsaaaagcdTadGgaagcaaccuL96 | 3414 | asdGsgudTg(Cgn)uccdTadCfUfuuucasug | 3594 | UAUGAAAAGCUAGGAAGCAACCU | 3774 |
| AD-1193469.1 | gsaaaaagcudAgdGaagcaacuuL96 | 3415 | asAfsggdTu(G2p)cuucdCuAfgCfuuuucsgsu | 3595 | AUGAAAAGCUAGGAAGCAACCUU | 3775 |
| AD-519773.3 | asasasagcUfuGfCfuuccUfaGfcuuuuscsa | 3416 | asAfsagGfudGfCfuuccUfaGfcuuuuscsa | 3596 | UGAAAAGCUAGGAAGCAACCUUU | 3776 |
| AD-1193470.1 | asasasagcuaGfGfAfagcaaccuuuL96 | 3417 | asAfsagdGudTgcuucCfuaGfcuuuuscsa | 3597 | UGAAAAGCUAGGAAGCAACCUUU | 3777 |
| AD-1193471.1 | asasasagcuaGfgGfAfagcaaccuuuL96 | 3418 | asAfsagdGudTgcuudCcUfadGcuuuuscsg | 3598 | UGAAAGCUAGGAAGCAACCUUUU | 3778 |
| AD-1193472.1 | asasasagcuaggAfAfgcaaccuuuuL96 | 3419 | asAfsaadGg(Tgn)ugcuuCfuAfgcuuususc | 3599 | GAAAAGCUAGGAAGCAACCUUUC | 3779 |
| AD-1193473.1 | asasagcuaggAfAfadGCfcaaccuuucuL96 | 3420 | asdGsaadAg(G2p)uugcuUfcUfagcuuususu | 3600 | AAAAGCUAGGAAGCAACCUUUCG | 3780 |
| AD-1193474.1 | asgscuaggaAfGfCfcaaccuuucguL96 | 3421 | asCfsgadAadGguugcuUfcCfuagcususu | 3601 | AAAGCUAGGAAGCAACCUUUCGC | 3781 |
| AD-1193475.1 | csusaggaAfgCfuaaccuuucgcL96 | 3422 | asCfsgadAadGguugdCuUfcCfuagscsu | 3602 | AGCUAGGAAGCAACCUUUCGC | 3782 |
| AD-1193476.1 | gscsuaggaaGfCfAfaccuuucguL96 | 3423 | asGfscgdAadAgguugcUfuCfcuagcsusu | 3603 | AAGCUAGGAAGCAACCUUUCGCC | 3783 |
| AD-1193477.1 | usasaggaagCfAfaccuuucgcuL96 | 3424 | asdGscgdAadAgguugcUfCfcuasgsc | 3604 | GCUAGGAAGCAACCUUUCGCC | 3784 |

TABLE 50-continued

Modified Sense and Antisense Strand Sequences of PNPLA3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1193478.1 | csusaggaagCfAfAfccuuucgccuL96 | 3425 | asGfsgcdGadAagguugCfuUfccuagscsu | 3605 | AGCUAGGAAGCAACCUUUCGCCU | 3785 |
| AD-1193479.1 | asgsgaagCfAfAfccuuucgccuL96 | 3426 | asdGsgcdGadAagguugCfuUfccusgsg | 3606 | CUAGGAAGCAACCUUUCGCCU | 3786 |
| AD-1193480.1 | usasggaagcAfAfCfccuuucgccuuL96 | 3427 | asAfsggdCgdAagguuCfuUfccuagsc | 3607 | GCUAGGAAGCAACCUUUCGCCUG | 3787 |
| AD-1193481.1 | gsgsaagcAfAfCfccuuucgccuuL96 | 3428 | asAfsggdCgdAaaggdTudGCfuccsusg | 3608 | UAGGAAGCAACCUUUCGCCUG | 3788 |
| AD-1193482.1 | asgsggaagcaAfCfCfuuucgccuguL96 | 3429 | asCfsagdGcdGaaagguUfgCfuuccusasg | 3609 | CUAGGAAGCAACCUUUCGCCUGU | 3789 |
| AD-1193483.1 | gsasagcaAfCfCfuuucgccuguL96 | 3430 | asCfsagdGcdGaaagguUfgCfuucscsu | 3610 | AGGAAGCAACCUUUCGCCUGU | 3790 |
| AD-1193484.1 | asasagcaaCfCfCfuuucgccuguuL96 | 3431 | asAfscadGg(Cgn)gaaaggUfudGcuuscsc | 3611 | GGAAGCAACCUUUCGCCUGUG | 3791 |
| AD-1193485.1 | asgscaacCfUfUfucgccuguguL96 | 3432 | asCfsacdAg(G2p)cgaadAgdGuUfgcususc | 3612 | GAAGCAACCUUUCGCCUGUGC | 3792 |
| AD-1193486.1 | gscsaaccUfUfUfcgcguguguacaL96 | 3433 | usGfscadCa(G2p)gcgaadAadGgUfugcsusu | 3613 | AAGCAACCUUUCGCCUGUGCA | 3793 |

TABLE 51

PNPLA3 Single Dose Screen in Hep3B Cells (% PNPLA3 mRNA remaining)

| Duplex | 50 nM Avg | 50 nM SD | 10 nM Avg | 10 nM SD | 1 nM Avg | 1 nM SD | 0.1 nM Avg | 0.1 nM SD |
|---|---|---|---|---|---|---|---|---|
| AD-67554.9 | 32.4 | 8.8 | 40.9 | 10.3 | 68.4 | 32.5 | 100.6 | 32.3 |
| AD-1193317.1 | 36.2 | 5.0 | 43.8 | 7.4 | 47.6 | 10.5 | 106.5 | 28.4 |
| AD-1193318.1 | 30.9 | 8.1 | 42.8 | 7.0 | 43.8 | 5.3 | 103.5 | 17.8 |
| AD-1193319.1 | 22.6 | 12.2 | 33.3 | 7.1 | 48.8 | 9.9 | 63.9 | 7.5 |
| AD-1193320.1 | 32.6 | 11.2 | 40.8 | 9.5 | 50.9 | 4.1 | 56.7 | 26.4 |
| AD-1193321.1 | 28.1 | 3.9 | 27.9 | 2.0 | 44.1 | 8.2 | 65.1 | 9.2 |
| AD-1193322.1 | 22.1 | 2.3 | 24.5 | 2.4 | 40.9 | 6.9 | 36.7 | 9.3 |
| AD-1193323.1 | 25.5 | 5.4 | 27.2 | 10.4 | 39.8 | 14.1 | 36.6 | 15.6 |
| AD-1193324.1 | 33.7 | 8.3 | 44.4 | 10.0 | 56.9 | 10.8 | 78.0 | 15.6 |
| AD-1193325.1 | 75.3 | 17.9 | 63.9 | 3.9 | 85.6 | 30.8 | 101.9 | 34.7 |
| AD-1193326.1 | 57.5 | 13.0 | 52.4 | 5.2 | 61.3 | 8.9 | 93.0 | 16.9 |
| AD-1193327.1 | 48.8 | 6.3 | 45.3 | 9.9 | 48.8 | 10.3 | 69.8 | 14.0 |
| AD-1193328.1 | 58.3 | 6.7 | 56.4 | 5.3 | 66.9 | 17.3 | 68.9 | 36.3 |
| AD-1193329.1 | 46.8 | 7.4 | 42.2 | 8.2 | 55.3 | 6.3 | 82.5 | 8.0 |
| AD-1193330.1 | 31.2 | 2.7 | 34.5 | 4.1 | 37.9 | 3.0 | 51.4 | 21.9 |
| AD-1193331.1 | 54.5 | 12.4 | 41.1 | 6.3 | 54.9 | 13.4 | 58.0 | 18.2 |
| AD-1193332.1 | 54.5 | 23.2 | 34.6 | 4.9 | 58.1 | 16.4 | 78.2 | 28.4 |
| AD-1193333.1 | 33.7 | 1.5 | 42.2 | 2.2 | 50.5 | 3.7 | 83.9 | 15.4 |
| AD-1193334.1 | 71.0 | 13.1 | 60.7 | 6.8 | 71.4 | 12.4 | 82.8 | 14.3 |
| AD-1193335.1 | 61.4 | 13.8 | 56.9 | 4.5 | 60.3 | 6.3 | 78.7 | 21.2 |
| AD-1193336.1 | 53.8 | 3.0 | 58.5 | 13.9 | 64.4 | 5.7 | 78.6 | 28.1 |
| AD-519346.3 | 24.2 | 4.9 | 36.1 | 11.5 | 36.6 | 6.2 | 82.0 | 24.6 |
| AD-1193337.1 | 18.2 | 3.6 | 22.6 | 3.8 | 43.5 | 19.6 | 39.8 | 9.5 |
| AD-1193338.1 | 28.6 | 3.8 | 36.7 | 7.0 | 42.4 | 2.0 | 86.3 | 20.2 |
| AD-1193339.1 | 25.9 | 3.6 | 31.4 | 3.6 | 45.5 | 9.0 | 78.7 | 15.8 |
| AD-1193340.1 | 33.8 | 2.7 | 35.2 | 4.7 | 42.4 | 11.5 | 70.2 | 13.0 |
| AD-1193341.1 | 28.6 | 5.5 | 34.0 | 2.4 | 57.0 | 10.4 | 63.2 | 19.3 |
| AD-1193342.1 | 25.7 | 4.4 | 31.1 | 6.8 | 39.0 | 4.1 | 66.3 | 11.2 |
| AD-1193343.1 | 24.6 | 5.9 | 32.5 | 2.5 | 37.8 | 4.9 | 81.0 | 16.1 |
| AD-1193344.1 | 23.0 | 3.3 | 34.6 | 4.2 | 33.2 | 7.9 | 46.7 | 12.8 |
| AD-1193345.1 | 23.4 | 4.2 | 35.3 | 11.8 | 40.6 | 9.6 | 79.2 | 10.7 |
| AD-1193346.1 | 18.7 | 2.9 | 30.6 | 3.4 | 47.9 | 4.7 | 90.3 | 24.4 |
| AD-1193347.1 | 28.5 | 6.6 | 43.9 | 3.9 | 57.9 | 9.7 | 73.1 | 21.1 |
| AD-1193348.1 | 38.2 | 2.4 | 38.9 | 2.8 | 52.3 | 9.7 | 64.7 | 15.0 |
| AD-1193349.1 | 26.4 | 3.9 | 40.9 | 7.1 | 43.5 | 4.4 | 75.6 | 4.4 |
| AD-519347.4 | 24.5 | 2.7 | 33.1 | 9.0 | 48.9 | 15.5 | 79.8 | 27.0 |
| AD-1193350.1 | 20.8 | 0.9 | 31.2 | 7.1 | 42.3 | 11.3 | 61.4 | 8.3 |
| AD-1193351.1 | 19.2 | 3.4 | 31.3 | 3.1 | 40.2 | 5.4 | 58.2 | 24.1 |
| AD-1193352.1 | 21.4 | 3.8 | 38.4 | 11.3 | 37.2 | 5.0 | 83.9 | 5.8 |
| AD-1193353.1 | 26.3 | 4.3 | 36.5 | 5.3 | 55.2 | 10.8 | 96.6 | 16.1 |
| AD-1193354.1 | 27.3 | 6.9 | 35.9 | 1.4 | 52.9 | 3.6 | 75.3 | 4.3 |
| AD-1193355.1 | 37.3 | 4.4 | 43.7 | 9.4 | 57.4 | 7.0 | 86.3 | 12.1 |
| AD-1193356.1 | 38.8 | 5.7 | 48.4 | 5.0 | 60.5 | 11.2 | 87.4 | 4.9 |
| AD-1193357.1 | 37.2 | 4.5 | 49.0 | 11.9 | 59.1 | 17.2 | 84.1 | 8.9 |
| AD-1193358.1 | 34.9 | 9.9 | 45.9 | 9.9 | 56.5 | 9.7 | 57.3 | 16.4 |
| AD-519350.4 | 32.6 | 3.5 | 36.3 | 13.8 | 47.7 | 9.4 | 96.7 | 23.3 |
| AD-1193359.1 | 33.5 | 2.0 | 33.5 | 1.6 | 54.4 | 6.9 | 85.0 | 18.8 |
| AD-1193360.1 | 28.7 | 5.5 | 39.8 | 3.3 | 50.9 | 9.7 | 85.3 | 14.3 |
| AD-1193361.1 | 33.0 | 4.4 | 42.5 | 4.3 | 49.0 | 4.3 | 59.5 | 6.2 |
| AD-1193362.1 | 33.3 | 6.6 | 46.4 | 10.6 | 62.4 | 12.3 | 61.4 | 7.8 |
| AD-1193363.1 | 25.4 | 2.7 | 35.3 | 4.8 | 46.1 | 6.1 | 59.5 | 21.1 |
| AD-1193364.1 | 28.7 | 3.3 | 29.0 | 3.4 | 53.3 | 14.5 | 67.2 | 13.3 |
| AD-1193365.1 | 20.7 | 3.8 | 29.3 | 9.2 | 40.6 | 4.3 | 56.7 | 13.2 |
| AD-1193366.1 | 30.5 | 1.7 | 39.8 | 7.1 | 41.7 | 6.3 | 82.0 | 30.9 |
| AD-1193367.1 | 29.3 | 9.0 | 37.5 | 10.3 | 41.9 | 7.7 | 77.8 | 26.0 |
| AD-1193368.1 | 36.2 | 7.7 | 42.7 | 6.1 | 52.5 | 9.8 | 72.3 | 16.8 |
| AD-1193369.1 | 51.7 | 23.9 | 47.4 | 4.8 | 45.9 | 3.4 | 70.7 | 15.6 |
| AD-1193370.1 | 29.9 | 4.6 | 43.4 | 2.9 | 52.7 | 14.2 | 76.6 | 20.3 |
| AD-1193371.1 | 34.5 | 5.1 | 31.4 | 7.4 | 38.9 | 6.5 | 65.9 | 11.0 |
| AD-1193372.1 | 30.8 | 3.7 | 39.4 | 8.7 | 48.0 | 6.4 | 77.3 | 5.3 |
| AD-519757.4 | 32.3 | 1.1 | 58.0 | 8.1 | 61.1 | 8.0 | 83.2 | 15.0 |
| AD-1193373.1 | 40.8 | 6.6 | 59.6 | 12.1 | 65.9 | 9.1 | 99.6 | 27.0 |
| AD-1193374.1 | 55.5 | 4.7 | 61.5 | 8.3 | 78.6 | 11.7 | 97.8 | 22.6 |
| AD-1193375.1 | 65.6 | 11.1 | 74.6 | 14.7 | 94.6 | 15.4 | 89.3 | 27.0 |
| AD-1193376.1 | 65.7 | 3.1 | 78.8 | 11.1 | 94.1 | 19.5 | 85.4 | 16.2 |
| AD-1193377.1 | 53.4 | 5.9 | 64.0 | 17.9 | 72.2 | 16.5 | 94.9 | 10.3 |
| AD-1193378.1 | 53.3 | 6.9 | 72.6 | 8.3 | 72.1 | 10.2 | 70.6 | 25.9 |
| AD-1193379.1 | 36.9 | 7.7 | 49.7 | 11.0 | 59.0 | 12.5 | 85.8 | 10.1 |
| AD-1193380.1 | 40.9 | 9.3 | 61.5 | 19.2 | 71.9 | 12.0 | 101.4 | 13.9 |
| AD-1193381.1 | 55.7 | 15.8 | 69.3 | 6.2 | 90.6 | 38.1 | 106.0 | 12.6 |
| AD-1193382.1 | 78.9 | 14.3 | 96.4 | 13.8 | 94.3 | 20.3 | 130.7 | 11.3 |
| AD-1193383.1 | 76.4 | 23.2 | 87.0 | 24.5 | 90.4 | 9.8 | 116.3 | 14.5 |
| AD-1193384.1 | 107.4 | 7.9 | 97.1 | 13.0 | 104.3 | 17.4 | 140.3 | 15.9 |
| AD-1193385.1 | 46.1 | 10.1 | 72.3 | 21.2 | 54.1 | 2.4 | 84.5 | 20.3 |
| AD-1193386.1 | 53.4 | 9.5 | 64.9 | 10.2 | 79.4 | 7.1 | 102.8 | 12.3 |
| AD-1193387.1 | 58.3 | 24.2 | 54.3 | 3.6 | 77.1 | 20.3 | 93.3 | 15.4 |
| AD-1193388.1 | 42.9 | 4.4 | 63.4 | 8.0 | 89.4 | 7.3 | 109.9 | 33.5 |
| AD-1193389.1 | 70.9 | 13.7 | 88.8 | 13.4 | 97.8 | 15.5 | 119.3 | 30.2 |
| AD-1193390.1 | 62.6 | 14.5 | 70.4 | 7.1 | 100.9 | 35.3 | 120.1 | 21.6 |
| AD-1193391.1 | 73.6 | 8.9 | 85.4 | 23.5 | 115.5 | 35.0 | 120.4 | 18.2 |
| AD-520018.9 | 25.3 | 4.0 | 41.3 | 5.9 | 60.8 | 9.8 | 110.1 | 16.8 |
| AD-1193392.1 | 27.9 | 6.9 | 42.9 | 11.9 | 51.1 | 17.6 | 85.4 | 10.3 |
| AD-1193393.1 | 34.4 | 10.9 | 39.7 | 14.6 | 47.3 | 11.7 | 78.6 | 12.3 |
| AD-1193394.1 | 33.8 | 6.8 | 52.5 | 16.4 | 56.8 | 4.6 | 62.7 | 23.2 |
| AD-1193395.1 | 27.7 | 9.0 | 42.8 | 10.1 | 54.3 | 7.6 | 69.2 | 16.8 |
| AD-1193396.1 | 36.3 | 11.7 | 51.3 | 3.4 | 58.4 | 18.1 | 90.3 | 23.6 |
| AD-1193397.1 | 44.5 | 13.8 | 62.3 | 12.7 | 50.0 | 18.9 | 74.2 | 16.6 |
| AD-1193398.1 | 27.3 | 7.4 | 47.5 | 5.1 | 52.8 | 4.0 | 87.0 | 19.6 |
| AD-1193399.1 | 35.8 | 6.6 | 45.3 | 10.1 | 58.4 | 15.9 | 89.7 | 11.7 |
| AD-1193400.1 | 27.1 | 5.8 | 47.1 | 14.5 | 59.1 | 13.8 | 72.1 | 16.1 |
| AD-1193401.1 | 26.7 | 17.3 | 46.4 | 2.6 | 64.4 | 8.5 | 85.5 | 22.4 |
| AD-1193402.1 | 25.9 | 14.1 | 38.7 | 12.2 | 48.1 | 3.9 | 64.4 | 22.7 |
| AD-1193403.1 | 30.4 | 8.6 | 44.7 | 7.2 | 54.5 | 4.0 | 81.1 | 15.1 |
| AD-1193404.1 | 27.6 | 12.1 | 46.4 | 4.7 | 36.0 | 13.6 | 76.3 | 18.6 |
| AD-1193405.1 | 26.8 | 5.4 | 38.3 | 3.6 | 51.1 | 3.1 | 76.2 | 10.8 |
| AD-1193406.1 | 29.0 | 9.9 | 35.3 | 6.9 | 54.2 | 3.3 | 96.3 | 21.3 |
| AD-1193407.1 | 21.5 | 7.1 | 32.0 | 7.3 | 47.7 | 5.0 | 61.4 | 11.1 |
| AD-520053.5 | 11.3 | 6.6 | 23.9 | 5.3 | 30.9 | 8.0 | 49.2 | 14.7 |
| AD-1193408.1 | 24.3 | 7.6 | 40.1 | 1.4 | 60.8 | 12.1 | 83.1 | 22.4 |
| AD-1193409.1 | 21.1 | 6.9 | 26.7 | 4.8 | 51.4 | 15.8 | 76.5 | 9.6 |
| AD-1193410.1 | 20.4 | 3.3 | 24.1 | 4.4 | 33.5 | 3.9 | 91.0 | 10.4 |
| AD-1193411.1 | 23.3 | 12.5 | 28.3 | 7.0 | 48.4 | 6.2 | 83.1 | 30.9 |
| AD-1193412.1 | 21.0 | 7.6 | 28.0 | 2.5 | 43.4 | 8.3 | 71.1 | 14.0 |
| AD-1193413.1 | 28.6 | 5.1 | 23.2 | 1.6 | 45.1 | 8.0 | 65.8 | 4.7 |
| AD-1193414.1 | 23.7 | 8.6 | 28.7 | 11.4 | 40.0 | 6.1 | 65.9 | 23.7 |
| AD-1193415.1 | 11.1 | 3.3 | 30.7 | 5.2 | 38.1 | 9.0 | 58.4 | 11.2 |
| AD-1193416.1 | 32.8 | 6.3 | 38.5 | 5.4 | 47.7 | 12.0 | 64.9 | 9.2 |
| AD-1193417.1 | 29.1 | 3.7 | 43.6 | 12.4 | 58.3 | 4.0 | 87.4 | 15.6 |
| AD-1193418.1 | 46.2 | 11.5 | 31.7 | 5.5 | 56.1 | 10.5 | 80.3 | 11.9 |
| AD-1193419.1 | 29.7 | 2.2 | 42.7 | 5.6 | 59.5 | 11.8 | 79.1 | 9.3 |
| AD-1193420.1 | 29.3 | 3.2 | 29.0 | 7.4 | 38.1 | 4.2 | 70.6 | 15.2 |
| AD-1193421.1 | 18.7 | 6.7 | 25.6 | 9.7 | 29.1 | 8.7 | 47.1 | 7.1 |
| AD-1193422.1 | 25.6 | 5.7 | 48.1 | 8.4 | 56.9 | 22.0 | 58.7 | 11.9 |
| AD-1193423.1 | 55.6 | 8.9 | 68.1 | 6.7 | 78.2 | 3.1 | 77.5 | 12.5 |
| AD-1193424.1 | 39.2 | 5.0 | 50.4 | 10.8 | 66.3 | 15.0 | 100.3 | 28.7 |
| AD-1193425.1 | 58.7 | 9.2 | 54.7 | 5.1 | 69.9 | 12.0 | 88.5 | 17.5 |
| AD-1193426.1 | 38.0 | 3.3 | 41.3 | 5.0 | 56.7 | 8.6 | 79.3 | 2.5 |
| AD-1193427.1 | 41.7 | 7.8 | 37.6 | 6.0 | 60.0 | 5.3 | 72.0 | 4.0 |
| AD-1193428.1 | 38.0 | 4.3 | 32.2 | 13.9 | 43.1 | 19.7 | 56.7 | 22.0 |
| AD-1193429.1 | 40.2 | 10.5 | 43.4 | 13.4 | 50.0 | 11.4 | 52.3 | 13.4 |
| AD-1193430.1 | 47.3 | 6.8 | 54.1 | 7.1 | 74.4 | 13.3 | 92.8 | 7.3 |
| AD-1193431.1 | 45.8 | 7.9 | 53.6 | 7.7 | 71.8 | 7.3 | 116.6 | 14.1 |
| AD-1193432.1 | 57.3 | 3.6 | 52.2 | 13.6 | 83.6 | 3.8 | 99.5 | 12.6 |
| AD-1193433.1 | 35.2 | 13.7 | 47.6 | 14.8 | 73.4 | 22.0 | 71.7 | 7.4 |
| AD-1193434.1 | 75.2 | 8.4 | 95.7 | 19.4 | 107.3 | 18.0 | 105.9 | 27.1 |
| AD-1193435.1 | 75.3 | 7.5 | 63.1 | 10.9 | 79.2 | 18.9 | 70.4 | 20.0 |
| AD-1193436.1 | 37.1 | 7.2 | 42.6 | 12.0 | 65.7 | 22.3 | 79.1 | 20.0 |
| AD-1193437.1 | 26.3 | 7.3 | 76.6 | 41.5 | 50.4 | 16.0 | 61.8 | 14.3 |
| AD-1193438.1 | 45.5 | 8.4 | 51.1 | 3.0 | 71.2 | 3.6 | 92.0 | 7.5 |
| AD-1193439.1 | 60.8 | 6.5 | 66.7 | 4.4 | 91.7 | 8.3 | 125.9 | 18.1 |
| AD-1193440.1 | 128.1 | 12.3 | 86.7 | 11.2 | 99.9 | 8.2 | 83.7 | 19.6 |
| AD-805631.3 | 76.1 | 9.0 | 73.7 | 7.9 | 109.0 | 18.9 | 100.3 | 15.6 |
| AD-1193441.1 | 71.4 | 12.6 | 91.6 | 13.0 | 116.1 | 20.7 | 103.1 | 26.0 |
| AD-1193442.1 | 51.4 | 6.5 | 54.7 | 5.6 | 67.8 | 15.5 | 106.9 | 31.6 |
| AD-1193443.1 | 31.6 | 8.6 | 41.7 | 11.1 | 44.0 | 12.5 | 79.0 | 29.5 |
| AD-1193444.1 | 83.4 | 2.4 | 73.6 | 17.1 | 92.4 | 11.7 | 84.3 | 25.3 |
| AD-1193445.1 | 86.5 | 4.5 | 85.5 | 15.1 | 94.5 | 27.8 | 103.3 | 9.7 |
| AD-1193446.1 | 79.6 | 15.2 | 72.5 | 9.0 | 91.1 | 18.9 | 87.7 | 10.1 |
| AD-1193447.1 | 117.4 | 18.9 | 99.1 | 15.4 | 115.7 | 27.8 | 91.8 | 20.5 |
| AD-1193448.1 | 47.7 | 7.7 | 52.1 | 7.4 | 74.2 | 16.2 | 93.2 | 24.0 |
| AD-1193449.1 | 43.0 | 12.3 | 52.4 | 10.0 | 64.4 | 1.9 | 84.5 | 10.8 |
| AD-1193450.1 | 43.2 | 14.8 | 68.7 | 11.6 | 71.6 | 16.2 | 68.3 | 12.5 |
| AD-1193451.1 | 52.4 | 13.9 | 72.2 | 6.5 | 77.8 | 15.9 | 63.2 | 10.4 |
| AD-1193452.1 | 70.9 | 12.6 | 81.1 | 5.6 | 97.2 | 19.5 | 97.2 | 11.8 |
| AD-1193452.2 | 71.9 | 14.7 | 89.6 | 13.0 | 112.4 | 14.3 | 109.8 | 22.8 |
| AD-1193453.1 | 88.9 | 15.4 | 83.1 | 11.0 | 97.1 | 27.3 | 98.8 | 12.3 |

TABLE 51-continued

PNPLA3 Single Dose Screen in Hep3B Cells (% PNPLA3 mRNA remaining)

| Duplex | 50 nM Avg | SD | 10 nM Avg | SD | 1 nM Avg | SD | 0.1 nM Avg | SD |
|---|---|---|---|---|---|---|---|---|
| AD-1193454.1 | 119.8 | 17.1 | 96.2 | 18.7 | 120.9 | 12.9 | 112.1 | 16.2 |
| AD-1193455.1 | 106.1 | 14.5 | 93.4 | 23.8 | 116.1 | 10.2 | 103.7 | 24.9 |
| AD-1193456.1 | 85.1 | 22.7 | 86.9 | 10.6 | 97.3 | 25.7 | 102.0 | 11.2 |
| AD-1193457.1 | 53.2 | 23.9 | 61.2 | 22.6 | 82.8 | 12.8 | 90.0 | 14.0 |
| AD-1193458.1 | 46.2 | 33.5 | 76.4 | 16.5 | 82.2 | 15.3 | 76.4 | 11.7 |
| AD-1193459.1 | 68.2 | 12.4 | 79.6 | 21.7 | 95.4 | 11.0 | 104.3 | 8.7 |
| AD-1193460.1 | 58.1 | 14.5 | 69.8 | 10.3 | 95.6 | 12.7 | 85.6 | 20.4 |
| AD-1193461.1 | 68.4 | 9.2 | 61.0 | 9.3 | 75.1 | 13.2 | 77.2 | 5.0 |
| AD-1193462.1 | 46.4 | 9.0 | 56.5 | 10.5 | 74.9 | 13.1 | 78.3 | 14.0 |
| AD-1193463.1 | 62.5 | 14.0 | 66.1 | 7.6 | 92.5 | 11.0 | 98.7 | 23.3 |
| AD-1193464.1 | 52.2 | 13.4 | 49.0 | 10.1 | 50.8 | 15.8 | 54.5 | 18.4 |
| AD-1193465.1 | 41.9 | 15.2 | 64.6 | 7.4 | 48.6 | 16.7 | 64.3 | 11.9 |
| AD-1193466.1 | 53.0 | 7.2 | 55.1 | 9.1 | 75.8 | 12.0 | 77.0 | 24.4 |
| AD-1193467.1 | 57.0 | 14.0 | 54.3 | 7.4 | 73.7 | 6.1 | 110.5 | 30.2 |
| AD-1193468.1 | 86.8 | 13.8 | 94.0 | 14.8 | 98.8 | 9.8 | 108.8 | 19.6 |
| AD-1193469.1 | 90.2 | 12.4 | 91.8 | 6.9 | 100.2 | 15.6 | 113.3 | 27.2 |
| AD-519773.3 | 56.2 | 2.7 | 57.4 | 13.3 | 54.7 | 9.0 | 107.0 | 5.6 |
| AD-1193470.1 | 55.4 | 8.7 | 39.1 | 7.8 | 42.3 | 9.2 | 68.4 | 10.3 |
| AD-1193471.1 | 46.6 | 21.6 | 48.9 | 5.9 | 36.5 | 4.8 | 60.4 | 19.0 |
| AD-1193472.1 | 70.7 | 22.1 | 76.2 | 10.3 | 101.6 | 15.8 | 63.0 | 1.2 |
| AD-1193473.1 | 62.6 | 16.1 | 60.0 | 16.7 | 82.6 | 6.0 | 107.0 | 23.5 |
| AD-1193474.1 | 55.0 | 15.6 | 57.0 | 12.2 | 70.5 | 15.9 | 81.5 | 14.3 |
| AD-1193475.1 | 71.9 | 4.8 | 59.2 | 2.5 | 74.5 | 13.3 | 116.9 | 22.5 |
| AD-1193476.1 | 67.6 | 12.1 | 65.6 | 6.0 | 76.1 | 6.5 | 132.8 | 18.8 |
| AD-1193477.1 | 67.6 | 3.5 | 65.7 | 13.6 | 62.6 | 7.6 | 108.6 | 28.3 |
| AD-1193478.1 | 65.9 | 18.6 | 50.6 | 5.2 | 49.8 | 8.2 | 91.1 | 16.4 |
| AD-1193479.1 | 34.1 | 12.3 | 45.2 | 4.2 | 39.2 | 11.6 | 106.3 | 37.4 |
| AD-1193480.1 | 30.1 | 8.0 | 52.1 | 11.6 | 51.3 | 5.7 | 83.1 | 14.8 |
| AD-1193481.1 | 33.2 | 4.9 | 41.1 | 7.0 | 67.2 | 15.6 | 96.1 | 21.9 |
| AD-1193482.1 | 38.8 | 5.8 | 52.8 | 13.4 | 57.2 | 6.8 | 99.4 | 26.1 |
| AD-1193483.1 | 42.5 | 11.4 | 60.0 | 21.7 | 77.5 | 14.5 | 112.1 | 35.1 |
| AD-1193484.1 | 47.2 | 6.9 | 48.9 | 7.7 | 80.6 | 6.7 | 79.2 | 16.9 |
| AD-1193485.1 | 65.2 | 5.0 | 78.8 | 10.8 | 82.5 | 10.8 | 94.5 | 16.5 |
| AD-1193486.1 | 94.3 | 12.1 | 93.6 | 10.7 | 71.4 | 30.8 | 106.2 | 9.5 |

TABLE 52

PNPLA3 Single Dose Screen (Free Uptake) in Primary Cynomolgus Hepatocytes (PCH) (% PNPLA3 mRNA remaining)

| Duplex | 500 nM Avg | SD | 100 nM Avg | SD | 10 nM Avg | SD | 1 nM Avg | SD |
|---|---|---|---|---|---|---|---|---|
| AD-67554.9 | 54.4 | n/a | 38.5 | 21.8 | 50.1 | 6.1 | 108.8 | 100.6 |
| AD-1193317.1 | 48.4 | 16.9 | 75.0 | 8.8 | 67.4 | 24.1 | 91.0 | 31.5 |
| AD-1193318.1 | 55.5 | 14.8 | 58.5 | 54.9 | 51.7 | 19.9 | 98.1 | 19.1 |
| AD-1193319.1 | 39.2 | 9.0 | 66.2 | 7.1 | 76.1 | 31.6 | 87.4 | 23.7 |
| AD-1193320.1 | 64.8 | 7.0 | 52.4 | 24.2 | 79.4 | 1.2 | 110.3 | 38.3 |
| AD-1193321.1 | 51.1 | 21.2 | 52.4 | 35.8 | 64.5 | 20.2 | 78.8 | 29.1 |
| AD-1193322.1 | 52.6 | 21.1 | 43.0 | 25.8 | 75.4 | 19.2 | 119.5 | 9.9 |
| AD-1193323.1 | 58.5 | 33.4 | 39.1 | 18.7 | 63.7 | 29.6 | 53.8 | 9.2 |
| AD-1193324.1 | 54.6 | 6.9 | 47.4 | 25.4 | 63.6 | 11.5 | 70.1 | 18.0 |
| AD-1193325.1 | 81.0 | 18.7 | 104.1 | 19.3 | 110.8 | 8.1 | 97.8 | 19.1 |
| AD-1193326.1 | 57.7 | 5.5 | 79.2 | 13.0 | 85.4 | 6.9 | 93.8 | 14.6 |
| AD-1193327.1 | 81.2 | 33.7 | 81.9 | 1.5 | 96.2 | 21.0 | 92.6 | 9.1 |
| AD-1193328.1 | 72.5 | 13.7 | 104.9 | 8.6 | 76.8 | 6.6 | 86.6 | 11.1 |
| AD-1193329.1 | 74.1 | 6.9 | 109.6 | 21.1 | 91.1 | 11.3 | 100.0 | 21.9 |
| AD-1193330.1 | 70.4 | 39.4 | 109.0 | 32.8 | 84.0 | 9.0 | 113.5 | 26.9 |
| AD-1193331.1 | 85.6 | 31.9 | 82.9 | 34.6 | 71.1 | 19.3 | 129.4 | 38.7 |
| AD-1193332.1 | 43.7 | 2.4 | 60.0 | 26.9 | 58.0 | 11.5 | 60.9 | 21.4 |
| AD-1193333.1 | 52.7 | 15.8 | 77.7 | 5.7 | 85.6 | 7.9 | 72.4 | 16.0 |
| AD-1193334.1 | 76.0 | 15.1 | 87.3 | 3.7 | 95.1 | 17.8 | 88.5 | 18.0 |
| AD-1193335.1 | 66.4 | 11.9 | 84.4 | 8.0 | 81.4 | 12.6 | 83.1 | 9.1 |
| AD-1193336.1 | 68.2 | 19.1 | 91.5 | 14.9 | 82.0 | 12.5 | 79.6 | 23.7 |
| AD-519346.3 | 64.0 | 25.2 | 85.5 | 11.1 | 91.2 | 25.5 | 85.5 | 14.0 |
| AD-1193337.1 | 38.0 | 4.8 | 72.8 | 28.5 | 78.0 | 18.5 | 90.7 | 1.8 |
| AD-1193338.1 | 47.0 | 4.8 | 76.9 | 35.9 | 61.0 | 16.6 | 60.9 | 16.7 |
| AD-1193339.1 | 54.1 | 20.8 | 60.2 | 11.0 | 86.7 | 23.9 | 80.9 | 16.3 |
| AD-1193340.1 | 55.2 | 20.6 | 65.7 | 16.6 | 107.2 | 55.6 | 78.7 | 13.2 |
| AD-1193341.1 | 45.4 | 9.6 | 55.8 | 3.2 | 78.0 | 5.9 | 78.2 | 8.1 |
| AD-1193342.1 | 41.4 | 10.0 | 62.7 | 7.7 | 76.7 | 10.8 | 89.2 | 5.1 |
| AD-1193343.1 | 45.6 | 12.4 | 71.8 | 8.6 | 68.6 | 8.3 | 88.4 | 6.0 |
| AD-1193344.1 | 55.8 | 7.6 | 58.3 | 18.6 | 73.8 | 3.6 | 66.9 | 20.4 |
| AD-1193345.1 | 62.1 | 3.6 | 74.5 | 36.7 | 78.6 | 36.5 | 58.7 | 19.9 |
| AD-1193346.1 | 54.5 | 5.0 | 55.0 | 3.8 | 97.5 | 5.4 | 85.3 | 11.0 |
| AD-1193347.1 | 66.3 | 19.3 | 67.3 | 5.6 | 107.0 | 29.0 | 95.2 | 9.4 |
| AD-1193348.1 | 65.0 | 15.8 | 80.9 | 13.5 | 99.3 | 26.6 | 98.7 | 22.8 |
| AD-1193349.1 | 50.3 | 14.0 | 70.3 | 22.0 | 91.5 | 11.7 | 85.3 | 10.7 |
| AD-519347.4 | 76.6 | 24.3 | 55.9 | 8.7 | 91.0 | 14.8 | 88.7 | 10.3 |
| AD-1193350.1 | 56.8 | 28.0 | 55.4 | 2.2 | 77.3 | 10.2 | 84.2 | 13.1 |
| AD-1193351.1 | 47.1 | 5.1 | 82.5 | 11.7 | 89.6 | 17.1 | 93.2 | 9.6 |
| AD-1193352.1 | 54.8 | 4.3 | 58.3 | 6.1 | 67.4 | 27.9 | 61.7 | 0.9 |
| AD-1193353.1 | 58.3 | 15.9 | 59.3 | 9.9 | 98.3 | 8.7 | 81.2 | 14.2 |
| AD-1193354.1 | 56.4 | 18.6 | 55.8 | 12.0 | 86.1 | 8.3 | 81.4 | 10.0 |
| AD-1193355.1 | 94.6 | 28.6 | 85.5 | 21.2 | 93.8 | 5.1 | 92.3 | 16.1 |
| AD-1193356.1 | 47.3 | 5.5 | 67.9 | 1.3 | 95.3 | 7.7 | 118.7 | 73.9 |
| AD-1193357.1 | 77.6 | 29.8 | 71.4 | 4.8 | 105.7 | 13.6 | 100.2 | 18.9 |
| AD-1193358.1 | 58.6 | 4.9 | 64.3 | 5.2 | 80.3 | 16.9 | 90.7 | 10.9 |
| AD-519350.4 | 60.4 | 15.2 | 59.5 | 23.5 | 57.5 | 3.4 | 60.3 | 21.1 |
| AD-1193359.1 | 80.7 | 10.4 | 96.2 | 7.6 | 112.2 | 13.5 | 91.1 | 16.0 |
| AD-1193360.1 | 102.6 | 27.0 | 93.5 | 14.4 | 114.6 | 11.9 | 81.5 | 9.4 |
| AD-1193361.1 | 82.2 | 14.8 | 87.1 | n/a | 115.4 | 19.7 | 165.0 | 127.4 |
| AD-1193362.1 | 109.2 | 38.9 | 97.3 | 11.6 | 109.6 | 9.1 | 149.9 | 76.0 |
| AD-1193363.1 | 77.0 | 20.4 | 91.1 | 5.8 | 90.6 | 8.1 | 90.0 | 5.6 |
| AD-1193364.1 | 68.6 | 17.3 | 96.6 | 10.5 | 97.0 | 9.0 | 100.3 | 15.4 |
| AD-1193365.1 | 77.6 | 29.1 | 96.0 | 13.2 | 100.9 | 5.3 | 90.6 | 9.3 |
| AD-1193366.1 | 68.9 | 9.1 | 87.9 | 15.9 | 83.7 | 20.1 | 51.9 | 18.7 |
| AD-1193367.1 | 75.7 | 15.2 | 96.0 | 16.5 | 112.8 | 9.9 | 74.0 | 4.5 |
| AD-1193368.1 | 86.7 | 14.7 | 90.9 | 14.5 | 115.5 | 20.4 | 82.2 | 8.8 |
| AD-1193369.1 | 72.4 | 26.0 | 101.3 | 5.4 | 142.9 | 32.6 | 125.0 | 45.8 |
| AD-1193370.1 | 94.2 | 29.8 | 101.4 | 7.7 | 121.2 | 6.5 | 95.5 | 17.0 |
| AD-1193371.1 | 72.8 | 21.4 | 90.5 | 5.3 | 113.5 | 10.1 | 87.6 | 8.0 |
| AD-1193372.1 | 109.7 | 37.6 | 102.7 | 19.0 | 107.2 | 20.6 | 84.2 | 10.4 |
| AD-519757.4 | 66.8 | 35.1 | 108.2 | 8.5 | 97.9 | 26.8 | 93.8 | 9.6 |
| AD-1193373.1 | 53.5 | 7.3 | 75.7 | 20.4 | 74.5 | 29.8 | 102.6 | 55.7 |
| AD-1193374.1 | 94.6 | 35.4 | 98.0 | 6.7 | 121.0 | 23.6 | 84.3 | 6.0 |
| AD-1193375.1 | 89.8 | 20.3 | 103.1 | 3.3 | 122.8 | 8.5 | 89.2 | 24.7 |
| AD-1193376.1 | 95.7 | 29.8 | 126.7 | 28.8 | 105.9 | 17.9 | 72.3 | 8.8 |
| AD-1193377.1 | 61.4 | 9.9 | 116.9 | 20.0 | 105.4 | 14.0 | 78.6 | 11.8 |
| AD-1193378.1 | 68.4 | 21.1 | 102.5 | 12.8 | 109.7 | 15.9 | 87.4 | 5.4 |
| AD-1193379.1 | 57.7 | 13.8 | 99.3 | 27.4 | 99.5 | 32.7 | 86.4 | 1.7 |
| AD-1193380.1 | 77.9 | 32.2 | 78.4 | 19.1 | 83.8 | 17.7 | 65.5 | 3.2 |
| AD-1193381.1 | 71.1 | 9.8 | 109.6 | 19.8 | 122.9 | 25.7 | 135.4 | 52.7 |
| AD-1193382.1 | 101.4 | 15.9 | 126.4 | 24.8 | 128.1 | 20.3 | 88.1 | 10.8 |
| AD-1193383.1 | 91.0 | 19.6 | 114.0 | 13.5 | 107.7 | 13.0 | 87.5 | 14.8 |
| AD-1193384.1 | 93.8 | 7.0 | 118.1 | 21.9 | 106.8 | 13.5 | 202.7 | 185.4 |
| AD-1193385.1 | 70.8 | 17.3 | 92.1 | 9.2 | 109.5 | 6.6 | 103.7 | 9.0 |
| AD-1193386.1 | 65.9 | 22.5 | 138.5 | 36.6 | 109.7 | 32.7 | 135.6 | 31.6 |
| AD-1193387.1 | 46.6 | 3.6 | 83.9 | 36.6 | 64.8 | 15.3 | 230.5 | 271.8 |
| AD-1193388.1 | 68.2 | 14.7 | 99.9 | 22.9 | 104.4 | 22.7 | 89.4 | n/a |
| AD-1193389.1 | 72.9 | 9.2 | 120.7 | 23.0 | 106.3 | 8.8 | n/a | n/a |
| AD-1193390.1 | 80.8 | 10.3 | 94.7 | 9.7 | 111.4 | 9.8 | 117.2 | n/a |
| AD-1193391.1 | 93.0 | 29.3 | 117.7 | 7.0 | 108.9 | 14.0 | n/a | n/a |
| AD-520018.9 | 75.1 | 35.9 | 85.7 | 11.8 | 86.3 | 2.5 | n/a | n/a |
| AD-1193392.1 | 95.1 | 34.0 | 117.4 | 11.4 | 115.5 | 6.3 | 292.6 | n/a |

TABLE 52-continued

PNPLA3 Single Dose Screen (Free Uptake) in Primary Cynomolgus Hepatocytes (PCH) (% PNPLA3 mRNA remaining)

| Duplex | 500 nM Avg | SD | 100 nM Avg | SD | 10 nM Avg | SD | 1 nM Avg | SD |
|---|---|---|---|---|---|---|---|---|
| AD-1193393.1 | 57.7 | 28.7 | 148.4 | 13.8 | 104.6 | 38.8 | 121.0 | 44.6 |
| AD-1193394.1 | 71.1 | 42.0 | 68.9 | 15.8 | 70.7 | 21.2 | 53.3 | 11.3 |
| AD-1193395.1 | 79.1 | 22.9 | 91.2 | 27.2 | 84.3 | 9.7 | 164.8 | 152.7 |
| AD-1193396.1 | 60.4 | 17.7 | 104.3 | 15.3 | 95.5 | 21.0 | 159.6 | 149.5 |
| AD-1193397.1 | 106.2 | 42.2 | 89.2 | 26.0 | 90.7 | 20.4 | 92.0 | n/a |
| AD-1193398.1 | 51.6 | 9.8 | 86.4 | 5.0 | 74.8 | 15.4 | 93.7 | 30.5 |
| AD-1193399.1 | 94.0 | 19.4 | 100.9 | 27.6 | 88.2 | 28.8 | 114.5 | 7.3 |
| AD-1193400.1 | 67.4 | 23.0 | 108.8 | 24.8 | 81.0 | 23.7 | 141.2 | 31.6 |
| AD-1193401.1 | 58.2 | 46.0 | 104.3 | n/a | 95.3 | 33.1 | 51.2 | 14.7 |
| AD-1193402.1 | 85.6 | 16.7 | 87.5 | 7.3 | 93.8 | 27.4 | 84.8 | 25.2 |
| AD-1193403.1 | 85.6 | 5.7 | 78.6 | 10.2 | 93.4 | 31.2 | 81.0 | 10.0 |
| AD-1193404.1 | 77.2 | 23.3 | 86.6 | 21.8 | 86.2 | 29.7 | 76.6 | 17.2 |
| AD-1193405.1 | 64.6 | 14.4 | 83.3 | 4.5 | 104.0 | 40.2 | 95.9 | 24.6 |
| AD-1193406.1 | 91.7 | 18.0 | 89.9 | 30.4 | 112.1 | 20.8 | 68.2 | 27.3 |
| AD-1193407.1 | 98.2 | 43.4 | 109.1 | 62.9 | 144.8 | 1.4 | 54.1 | 19.2 |
| AD-520053.5 | 66.3 | 18.3 | 88.0 | 41.5 | 103.2 | 44.9 | 56.0 | 15.6 |
| AD-1193408.1 | 47.2 | 2.1 | 41.0 | 12.2 | 84.0 | 21.0 | 63.0 | 23.6 |
| AD-1193409.1 | 64.7 | 10.7 | 59.4 | 8.3 | 76.3 | 9.7 | 95.1 | 5.2 |
| AD-1193410.1 | 62.9 | 10.1 | 48.1 | 3.2 | 72.6 | 7.7 | 104.7 | 20.2 |
| AD-1193411.1 | 53.0 | 5.2 | 48.3 | 3.5 | 70.9 | 14.0 | 95.5 | 11.5 |
| AD-1193412.1 | 48.9 | 2.2 | 43.6 | 4.3 | 69.7 | 9.3 | 91.1 | 6.6 |
| AD-1193413.1 | 58.6 | 4.9 | 55.0 | 8.9 | 84.6 | 5.4 | 100.2 | 11.6 |
| AD-1193414.1 | 82.3 | 15.4 | 76.3 | 16.6 | 124.2 | 13.5 | 105.5 | 27.3 |
| AD-1193415.1 | 80.8 | 14.3 | 111.6 | 10.4 | 120.4 | 34.2 | 84.8 | 5.2 |
| AD-1193416.1 | 44.3 | 17.6 | 51.8 | 21.1 | 63.4 | 3.7 | 78.7 | 19.1 |
| AD-1193417.1 | 54.6 | 19.1 | 51.2 | 4.5 | 65.4 | 6.7 | 82.0 | 5.4 |
| AD-1193418.1 | 64.5 | 7.1 | 62.9 | 3.4 | 65.9 | 3.0 | 93.2 | 2.6 |
| AD-1193419.1 | 55.5 | 3.0 | 51.8 | 3.6 | 67.3 | 1.4 | 77.9 | 13.2 |
| AD-1193420.1 | 54.5 | 3.8 | 51.7 | 3.7 | 79.7 | 11.6 | 89.0 | 9.3 |
| AD-1193421.1 | 63.3 | 4.7 | 62.3 | 4.1 | 101.2 | 8.2 | 80.0 | 10.4 |
| AD-1193422.1 | 137.5 | 11.1 | 106.8 | 11.5 | 122.0 | 39.4 | 85.9 | 13.3 |
| AD-1193423.1 | 63.3 | 37.2 | 79.9 | 2.0 | 110.5 | 47.4 | 102.9 | 13.4 |
| AD-1193424.1 | 66.9 | 9.9 | 59.7 | 5.7 | 74.1 | 4.8 | 101.5 | 8.0 |
| AD-1193425.1 | 80.4 | 8.1 | 78.9 | 13.3 | 73.7 | 8.3 | 94.9 | 4.0 |
| AD-1193426.1 | 53.1 | 4.4 | 55.7 | 3.4 | 71.8 | 14.5 | 68.5 | 4.5 |
| AD-1193427.1 | 71.1 | 5.7 | 81.1 | 14.3 | 81.3 | 11.3 | 79.5 | 10.2 |
| AD-1193428.1 | 76.2 | 4.7 | 63.5 | 4.0 | 113.3 | 30.1 | 83.7 | 10.3 |
| AD-1193429.1 | 101.4 | 3.2 | 116.4 | 47.0 | 160.6 | n/a | 89.7 | 28.5 |
| AD-1193430.1 | 45.8 | 38.4 | 53.8 | 15.8 | 83.4 | 16.3 | 113.0 | 1.1 |
| AD-1193431.1 | 63.6 | 4.2 | 65.2 | 6.5 | 72.9 | 1.8 | 113.3 | 9.6 |
| AD-1193432.1 | 68.0 | 7.5 | 71.2 | 2.0 | 75.8 | 7.3 | 111.8 | 10.1 |
| AD-1193433.1 | 71.7 | 5.2 | 70.2 | 8.4 | 70.6 | 2.3 | 106.4 | 11.2 |
| AD-1193434.1 | 81.4 | 11.3 | 77.2 | 4.6 | 79.3 | 4.0 | 93.1 | 7.0 |
| AD-1193435.1 | 87.4 | 8.7 | 87.6 | 6.8 | 94.9 | 22.5 | 90.5 | 12.3 |
| AD-1193436.1 | 71.3 | 3.1 | 65.7 | 7.0 | 105.7 | 4.6 | 91.1 | 10.6 |
| AD-1193437.1 | 77.3 | 5.3 | 72.6 | 11.3 | 141.9 | 9.7 | 95.0 | 15.0 |
| AD-1193438.1 | 41.1 | 18.3 | 33.7 | 32.0 | 81.9 | 21.3 | 97.1 | 17.2 |
| AD-1193439.1 | 65.3 | 5.1 | 69.9 | 1.3 | 70.4 | 8.2 | 127.4 | 20.2 |
| AD-1193440.1 | 104.4 | 13.4 | 99.9 | 21.5 | 84.6 | 5.0 | 97.7 | 20.0 |
| AD-805631.3 | 79.1 | 11.9 | 72.1 | 5.5 | 80.3 | 4.2 | 113.0 | 23.4 |
| AD-1193441.1 | 86.8 | 4.5 | 83.1 | 5.8 | 97.6 | 43.6 | 100.0 | 4.8 |
| AD-1193442.1 | 80.2 | 8.9 | 72.2 | 18.5 | 100.2 | 13.0 | 106.3 | 10.8 |
| AD-1193443.1 | 78.1 | 6.5 | 82.3 | 13.4 | 128.2 | 33.5 | 95.1 | 12.7 |
| AD-1193444.1 | 64.0 | 25.7 | 68.3 | 32.7 | 65.0 | 1.0 | 96.2 | 16.6 |
| AD-1193445.1 | 89.9 | 3.1 | 82.1 | 8.0 | 83.9 | 6.2 | 122.6 | 17.3 |
| AD-1193446.1 | 91.0 | 3.6 | 72.2 | 26.3 | 84.8 | 18.6 | 106.8 | 13.6 |
| AD-1193447.1 | 89.7 | 13.6 | 90.9 | 4.7 | 89.7 | 17.9 | 120.1 | 8.8 |
| AD-1193448.1 | 63.6 | 2.9 | 68.7 | 7.1 | 79.0 | 4.4 | 99.2 | 12.5 |
| AD-1193449.1 | 74.6 | 3.9 | 70.3 | 6.9 | 95.2 | 15.3 | 96.7 | 13.9 |
| AD-1193450.1 | 81.5 | 5.8 | 80.2 | 4.9 | 169.5 | 25.9 | 98.5 | 16.1 |
| AD-1193451.1 | 95.7 | 26.0 | 82.5 | 8.3 | 216.4 | n/a | 106.5 | 5.6 |
| AD-1193452.1 | 66.7 | 24.1 | 49.9 | 40.7 | 74.7 | 1.1 | 81.5 | 24.5 |
| AD-1193452.2 | 87.1 | 6.8 | 88.1 | 8.1 | 90.0 | 13.8 | 137.9 | 18.9 |
| AD-1193453.1 | 82.9 | 9.0 | 82.9 | 2.9 | 81.5 | 10.7 | 141.1 | 11.7 |
| AD-1193454.1 | 87.6 | 23.1 | 88.8 | 3.9 | 101.0 | 19.5 | 111.0 | 17.2 |
| AD-1193455.1 | 102.3 | 32.6 | 92.3 | 13.5 | 87.1 | 10.5 | 91.3 | 7.0 |
| AD-1193456.1 | 96.7 | 14.6 | 87.2 | 5.4 | 105.9 | 12.1 | 115.5 | 10.1 |
| AD-1193457.1 | 85.5 | 9.2 | 85.9 | 8.6 | 170.3 | 23.2 | 113.7 | 5.8 |
| AD-1193458.1 | 75.7 | 17.2 | 91.9 | 22.6 | 142.2 | 22.9 | 90.9 | 2.9 |
| AD-1193459.1 | 70.5 | 31.2 | 69.6 | 18.7 | 65.9 | 19.3 | 95.5 | 32.7 |
| AD-1193460.1 | 83.5 | 4.8 | 77.5 | 9.3 | 75.2 | 0.5 | 121.8 | 17.7 |
| AD-1193461.1 | 64.3 | 7.6 | 67.3 | 10.5 | 70.8 | 5.6 | 115.5 | 16.9 |
| AD-1193462.1 | 62.9 | 1.3 | 61.4 | 4.1 | 81.9 | 8.5 | 109.8 | 15.6 |
| AD-1193463.1 | 74.5 | 10.8 | 68.4 | 3.4 | 107.4 | 6.8 | 97.8 | 19.2 |
| AD-1193464.1 | 77.3 | 5.6 | 78.5 | 11.5 | 147.0 | 26.5 | 105.9 | 13.6 |
| AD-1193465.1 | 86.4 | 36.5 | 83.0 | 13.2 | 193.7 | n/a | 89.4 | 17.2 |
| AD-1193466.1 | 51.6 | 12.2 | 48.2 | 10.9 | 68.8 | 12.4 | 91.0 | 26.1 |
| AD-1193467.1 | 99.4 | 18.0 | 84.9 | 3.2 | 74.5 | 6.4 | 126.9 | 4.0 |
| AD-1193468.1 | 97.3 | 13.6 | 97.0 | 12.8 | 88.4 | 8.6 | 123.7 | 14.9 |
| AD-1193469.1 | 89.6 | 7.6 | 78.1 | 17.0 | 99.4 | 13.3 | 101.6 | 16.1 |
| AD-519773.3 | 63.3 | 4.0 | 60.5 | 7.6 | 112.7 | 24.3 | 129.6 | 23.3 |
| AD-1193470.1 | 70.9 | 9.0 | 64.6 | 4.3 | 135.9 | 24.9 | 106.4 | 23.0 |
| AD-1193471.1 | 77.9 | 23.5 | 85.3 | 2.5 | 161.9 | 11.1 | 80.6 | 8.5 |
| AD-1193472.1 | 63.9 | 39.9 | 64.2 | 26.0 | 77.2 | 15.5 | 74.3 | 17.8 |
| AD-1193473.1 | 86.6 | 5.0 | 80.5 | 3.9 | 79.6 | 10.8 | 115.1 | 7.9 |
| AD-1193474.1 | 90.1 | 2.3 | 81.1 | 4.6 | 79.5 | 5.5 | 124.9 | 14.6 |
| AD-1193475.1 | 82.5 | 22.7 | 84.1 | 8.0 | 79.1 | 8.1 | 118.2 | 19.9 |
| AD-1193476.1 | 86.6 | 5.2 | 85.2 | 8.8 | 83.2 | 3.5 | 122.2 | 9.6 |
| AD-1193477.1 | 81.2 | 1.1 | 80.2 | 8.8 | 87.0 | 9.1 | 101.2 | 8.3 |
| AD-1193478.1 | 100.9 | 16.7 | 85.4 | 5.6 | 155.3 | 20.6 | 109.3 | 6.3 |
| AD-1193479.1 | 119.3 | 1.8 | 90.0 | 41.1 | 171.3 | 27.4 | 75.2 | 15.7 |
| AD-1193480.1 | 46.4 | 25.9 | 62.2 | 19.4 | 57.8 | 12.2 | 72.1 | 18.6 |
| AD-1193481.1 | 65.0 | 48.7 | 72.5 | 24.4 | 83.0 | 6.9 | 105.4 | 12.0 |
| AD-1193482.1 | 76.5 | 22.8 | 74.0 | 16.5 | 86.0 | 18.6 | 108.5 | 9.9 |
| AD-1193483.1 | 82.1 | 21.3 | 68.0 | 34.6 | 79.0 | 4.3 | 76.6 | 17.6 |
| AD-1193484.1 | 85.8 | 38.5 | 63.2 | 38.2 | 81.8 | 11.2 | 83.2 | 18.2 |
| AD-1193485.1 | 75.7 | 11.8 | 81.3 | 10.4 | 99.7 | 14.4 | 71.1 | 22.4 |
| AD-1193486.1 | 106.3 | 27.5 | 86.8 | 11.7 | 172.4 | 64.3 | 77.1 | 28.3 |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (3793 sequences)

SEQ ID NO: 1 - DNA, 2805 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagac

SEQ ID NO: 2 - DNA, 2805 bp, Homo sapiens
gtctttatttctacactctctcatcgccacacatggggagaaactcactgaccatgtggggctggtccctgcagaaaataagccaggttcaagttgtgtgctccagtggagaggaggcggaagctcctgctgtgcttggctcctgcctggggggctgaggtgaatgccctgcacactagattattttgttttttaaattttttttttttgagtcagactttcactcatgttgcccaggctggaatgaaatggtgcaatctcagctcaccgcaacctccgcctcctgggttcaagtgattctcctgcctcagccttccgaatagctgggattacaggcatgcaccaccatgcccagataatttttgtatttttagtagagacagggttttgctatgttggccagactggtcttgaactcctgacctcaggtgatctgccaaccttggcctcccaaagtgctgggattacagccgtgtgccactgcacccaaccgatttttttttttttaaggcttattctactaacatctcactgattcacataatacaaaattcaacaggtaacaacgcttccttacatttttatacaaaactctttaaacattattttagttaggtgaaaaaggtgttctaaaattaagtagattatcatcttgttacccccgccatggagacgtttttagtagtcaaggttatcatctttgcagaccacctgacaggcagtgtcgttcttggggacgaactgcaccccttcccacagcatggggaagtgggatcatgctattctcttccctccaccccacaagatcacacatgggccagcctaccccccatcacaaggcccccacccatccaaacacctgtcattctaagaacctcatgctggaacagtctgaccattaatagggccacgaaacagtcagtaagggaccctctgcactgggcttcctggtgtcatttcccaaccagctgaattaacgcatgctgatgtattagagttaagtgctggaccgctgcacaggcgaaaggttgcttcctagcttttcataaaaccaactcagctcagaggctgggatcctccacgtcacaggcaggggtcactacacagcaatgcggaggtagctgcacaaagatgggaaactttagcacctctgaaagaatctgctagactcgcctcctcaagtgactcacagactcttctctagtgaaaaactgggaaaggtggagagcccctcagcaccagcaggtactttattgcccaagaagaagttcaggctggacctgaggatggaccgcggggtggcctctgctttggtctctgctggacagcccttgggggagcagggagtccagcagggccagtcctgctcaggtgtgcatggggaggcctgttggctgctcactggcatttgggacctggaggcggggagcagacacatcagcactcgagtgaacacctgtgaggtcacccactgcaaccacaggacatcgtcgggcatatctggaagccatgtcaccagtctctggacaatcgcaatggcagattccacaggcagggtacagggcagcattacataagacattatcctaatgggtagcaagttgcaaatcttgctcatgtatccacctttgtctttcatttcttcactcagtgctgtagcgagcctgggcgagagggtgtccaggatgctctcatcccagggcaggatgctgagacgcaggtggtctagcagctcatctccctccagcctcacagccaaggcagccgactccggggaagaatccagactcatgtttgcccagctgggcatggcgacctcaggatccatcccttctgaggatgacttcaggcctggctggggcctgttgcagatgcccttctcttccaagaacctgaatgcatccaaatatcctcgaaggcatatctctcccagcaccttgagatccggggggacaaaagctctcgagagaaggtagaggttccctgtgcagaggcgtagactgagcttggtgatgtccacatgaagaaagttcgtggacttgactttagggcagatgtcgtactccccatagaagggggacacggtgatggttgttttggcatcaatgaagggtacgttgtcactcactcctccatccacatatcgcacgcctctgaaggaaggagggataaggccactgtagaaggggatgaagcaggaacataccaaggcatccacgacttcgtctttggaccgaaagtcagacaccagaacgttttccccatcagacactctggtaagagagatgcctattttgccggagatgagctggtggacattggccgggaggcatttgcagagaccctgtcggaggaacttgcttaagttgaaggatggatggaagatgccaatgttccgactcctggccttccgcacaagatctgagaggacctgcagagtctgctccagcgggataccggagaggacgccgacgcagtgcaacgccccggccgaagcgccgaacaacatgcgcgcgtcgcggaggaggtgcggggcgtgctcgctcaggcagcgggtcgccccgacgtggtagaagcccaggaagccgcagcccgcgaaggacaagctccagccgcgctctgcgtcgtacatggcggcggcggcggggcgggggcgcgggttaggatctgggtcgggatcgggaatcggctcgggtcctgatccgcagcagctccgcccggcgcccgcaagcgctctctaccctgcctcagtgtctcggccagggcattcccagcgcgacgtcagccccgcccccctcggaccat

SEQ ID NO: 3 - DNA, 4649 bp, Mus musculus
agagcagcaacaccgggagcagagctgaactgcagcgccgcccggagcttcaagcaccatgtatgacccagagcgccgctggagcctgtcgtttgcaggctgcggcttcctgggcttctaccacgtcggggctacgctatgtctgagcgagcgcgccccgcacctcctccgcgatgcgcgcactttctttggctgctcggccggtgcactgcacgcggtcaccttcgtgtgcagtctccctctcggccgtataatggagatcctcatggacctcgtgcggaaagccaggagccgcaacatcggcaccctccacccgttcttcaacattaacaagtgcatcagagacgggctccaggagagcctcccagacaatgtccaccaggtcatttctggcaaggttcacatctcactcaccagggtgtcggatggggagaacgtgctggtgtctgagttccattccaaagacgaagtcgtggatgccctggtgtgttcctgcttcattcccctcttctctggcctaatccctccttccttccgaggcgagcggtacgtggacggaggagtgagcgacaacgtccctgtgctggatgccaaaaccaccatcacggtgtcacctttctacggtgagcatgacatctgccccaaagtcaagtccaccaacttcttccacgtgaatatcaccaacctcagcctccgcctctgcactgggaacctccaacttctgaccagagcgctcttcccgtctgatgtgaaggtgatgggagagctgtgctatcaagggtacctggacgccttccggttcctggaggagaatggcatctgtaacgggccacagcgcagcctgagtctgtccttggtggcgccagaagcctgcttggaaaatggcaaacttgtgggagacaaggtgccagtcagcctatgctttacagatgagaacatctgggagacactgtcccccgagctcagcacagctctgagtgaagcgattaaggacagggagggctacctgagcaaagtctgcaacctcctgcccgtcaggatcctgtcctacatcatgctgccctgcagtctgcccgtggagtcggctatcgctgcagtccacaggctggtgacatggctccctgatatccaggatgatatccagtggctacaatgggcgacatcccaggtttgtgcccgaatgacgatgtgcctgctcccctctaccaggtaaatacttgggcccagggtgtgtgggccagataggcatccctcccggttgttcccagagctcttagggtcagagcttgggtggtgacagccttaacaagccaggctcagccgcctgtccccagcatgccattaaagaaaccggtagcagagaaagcaggtttattcgaatataaaaaggttcaagcccccacccggttaatctttaagataccaacaggaggcttaagtttaaacagagttacacataaacagtctgaatcagggcgtggtcctgcccaccattgtctgggcttcaaggttccttctttctctccctagcatgagattcctgggacaatcccaattccttggcctccattgtatcaaagggctgaaaaccaaagggaaggcacagctgtctcttcagcatgcctcttctgccagaaccactgcaaggtttggtgctcaggctgtgcaaacattctagcaatgtttgactcagtgtcaagcaggtgacaaggaacatggtgctgtgtggggggaacccatggcccaggtgagggcttattggtgggtgaagctgtgggtgttcaggtggtggagaaggccttaagggatgggactgacacctcagcactgaaggcaggaggaagctgtggctctgggttgcacccctgcctggctccaccctctctggcatctgtagaagttacagctggttcttcctctcagccccatgctcccagaaataagactcagacccaaattatagttacaaataccttggccatatagctaggctcttctcagactagctcataacttaactcattaattttaacctccatcctgccacatggctggtggcctgtgctcaggtaccatgagtccagctcttcacatctttccggatgaatcttccataattctttctgcctcctggatgttccaccttctattccaccttttcctataggccatggttttgtttttgttttttttttccaaatttaatttaattaattaatttatttatttttggtttttcgagacagggtttctctgtatcgccctggctgtcctggaactcactatgtaagccaggctggcctcaaactcagaaatccgcctgcctctgcctcctgagtgctgggattaaaggcgtgcgcaaccatgcccggtgtggtttttttttttttttaattgacaggtggatgcatctatataatccataacatattctctctacaggtatctattaggttttgggtgaggtgtggagttctagggaactctgagagaaattcctggggagtaagtggtttatcaagttgattggaggagtttttaatgctatggacagacagacagaaggacaacagcatagtcggggctaccagggagttcaggccccggcatcggagatagaagcaggatggggtctttgaagagattctgagcccacacagcagaggagggactctctctttagagcttttgaggatgagggaggttgactgcaagagcctacagccaggctcgaggcaggcagggggtggggagcaggatgtaaaccccttcgatgctgacagactcacttctggggtaaaatattatgagatgcctgtcagtgtctgtgaagagacctgagcagagtctggattctgacatcaatcatgttcttacaatactgaagacctgagagcctgcaatcttggtttgtaaattgctggtctccgtgcttccagtgaacttggacattcttctcatggttggtccaggagaggccaaagctgagggcaccctgccttccacccccagtccagcttgaccttttatctggagcaacagtgtctagatgatgggtgggtgaggggtgctatactgtctgtccctctgggaagggttctgttacttttggaggcagctaggaagtttctctgtgcagctgccccctggtgctgtgtggtgacctcattgcctgtgaccccaggatcacaggatctgggctaaagtggtagtccatagaaaccaaagacaatgatttggtgtttagaaagctactcttggtctgggtgaagtctggtgcttaagggctatcacaaagagcgtgtcaaaccatctctcagcctgtgagtcagtggggagcccaagggcatcagtgtttggaaactggaatccaaaccgggcaatctcggaaggaaactgtttaggaattgtgatgggacgggccgtggctgtctctgaaaagggcctgccagataacttattacttttaaggacacctttggctcttactaatttataaagcattttatataaacacaccagggagtgcatggtgaactacacgtatgatcagttaagtggggctagaattaggtagggagagcatcggacctctgcctcctcaacctcaacttgcttgctttctccactggctccaaatctttgtatagtcatcagccatgaccacctctctccctccccatctactaccagcagcgttaatgggaataagtacccacttctctcaggtgtactatacagctgtgggtgtggtgtgtgtttcctgtaattcacactttagaaaggaaacaagcaaacaaaagaaaccaggtgctgcccatactcctaagtgtagacagtgaaggtgtgtgtctcccatgcctgagtctcctggaggcctagtgagctccaggttcatgcaagcacatcaggaggaatcatataatctcagcacggttgatccagatgggataagaaaggactctgggagagagaatgtggttctagagacaaagtgtctaggctacacagaagataagactgtcccaaggaaagaaaagaaaccaggaactagggtgcagctcagttgtcagaggacttctctaggcttgaagcccagagtccaatctcagcaccttataaactgtggagtgacaggcagtgacatcggcctgtaatcccaacactcaagcagtagaggcaagaggatcataagttcaaggtcttccttggctatttagggagttggaggttagctctggctacatgagaccctgtctcaaaaaaaaaaaaaaaaaaaagtagaaacttctgccttgctttgagctgcccctttctggacgtttctcatcagtagagaatattcctgccaccctatcagacaaaactcccactggtttggagtctctccattctcaggaacacctcaggagtcagacagtgagcagcagggagcaatgtcttgacttgtaagccccttagcaaggctggttcatttgtttattaaaagcaggtgtgggtgaatttatgcaaatgagtatgcaaactagtggaacagcagaaggattgaatggatacaccaaaaataaccacaactgtttaagggaaaagggtccataataaatgtggggaacaaaaaacaaataaatgtgattttttttagaaaaatg

SEQ ID NO: 4 - DNA, 4649 bp, Mus musculus
catttttctaaaaaaaatcacatttatttgttttttgttccccacatttattatggacccttttcccttaaacagttgtggttatttttggtgtatccattcaatccttctgctgttccactagtttgcatactcatttgcataaattcacccacacctgcttttaataaacaaatgaaccagccttgctaaggggcttacaagtcaagacattgctccctgctgctcactgtctgactcctgaggtgttcctgagaatggagagactccaaaccagtgggagttttgtctgatagggtggcaggaatattctctactgatgagaaacgtccagaaaggggcagctcaaagcaaggcagaagtttctacttttttttttttttttttttgagacagggtctcatgtagccagagctaacctccaactccctaaatagccaaggaagaccttgaacttatgatcctcttgcctctactgcttgagtgttgggattacaggccgatgtcactgcctgtcactccacagtttataaggtgctgagattggactctgggcttcaagcctagagaagtcctctgacaactgagctgcaccctagttcctggtttcttttctttccttgggacagtcttatcttctgtgtagcctagacactttgtctctagaaccacattctctctcccagagtcctttcttatcccatctggatcaaccgtgctgagattatatgattcctcctgatgtgcttgcatgaacctggagctcactaggcctccaggagactcaggcatgggagacacacaccttcactgtctacacttaggagtatgggcagcacctggtttcttttgtttgcttgtttcctttctaaagtgtgaattacaggaaacacacaccacacccacagctgtatagtacacctgagagaagtgggtacttattcccattaacgctgctggtagtagatggggagggagagaggtggtcatggctgatgactatacaaagatttggagccagtggagaaagcaagcaagttgaggttgaggaggcagaggtccgatgctctccctacctaattctagccccacttaactgatcatacgtgtagttcaccatgcactccctggtgtgtttatataaaatgctttataaattagtaagagccaaaggtgtccttaaaagtaataagttatctggcaggcccttttcagagacagccacggcccgtcccatcacaattcctaaacagtttccttccgagattgcccggtttggattccagtttccaaacactgatgcccttgggctccccactgactcacaggctgagagatggtttgacacgctctttgtgatagcccttaagcaccagacttcacccagaccaagagtagctttctaaacaccaaatcattgtctttggtttctatggactaccactttagcccagatcctgtgatcctggggtcacaggcaatgaggtcaccacacagcaccagggggcagctgcacagagaaacttcctagctgcctccaaaagtaacagaacccttcccagagggacagacagtatagcacccctcacccacccatcatctagacactgttgctccagataaaaggtcaagctggactgggggtggaaggcagggtgccctcagctttggcctctcctggaccaaccatgagaagaatgtccaagttcactggaagcacggagaccagcaatttacaaaccaagattgcaggctctcaggtcttcagtattgtaagaacatgattgatgtcagaatccagactctgctcaggtctcttcacagacactgacaggcatctcataatattttaccccagaagtgagtctgtcagcatcgaaggggtttacatcctgctccccaccccctgcctgcctcgagcctggctgtaggctcttgcagtcaacctccctcatcctcaaaagctctaaagagagagtccctcctctgctgtgtgggctcagaatctcttcaaagaccccatcctgcttctatctccgatgccggggcctgaactccctggtagccccgactatgctgttgtccttctgtctgtctgtccatagcattaaaaactcctccaatcaacttgataaaccacttactccccaggaatttctctcagagttccctagaactccacacctcacccaaaacctaatagatacctgtagagagaatatgttatggattatatagatgcatccacctgtcaattaaaaaaaaaaaaaaaccacaccgggcatggttgcgcacgcctttaatcccagcactcaggaggcagaggcaggcggatttctgagtttgaggccagcctggcttacatagtgagttccaggacagccagggcgatacagagaaaccctgtctcgaaaaaccaaaaataaataaattaattaattaaattaaatttggaaaaaaaaaacaaaaacaaaaccatggcctataggaaaaggtggaatagaaggtggaacatccaggaggcagaaagaattatggaagattcatccggaaagatgtgaagagctggactcatggtacctgagcacaggccaccagccatgtggcaggatggaggttaaaattaatgagttaagttatgagctagtctgagaagagcctagctatatggccaaggtatttgtaactataatttgggtctgagtcttatttctgggagcatggggctgagaggaagaaccagctgtaacttctacagatgccagagagggtggagccaggcaggggtgcaacccagagccacagcttcctcctgccttcagtgctgaggtgtcagtcccatcccttaaggccttctccaccacctgaacacccacagcttcacccaccaataagccctcacctgggccatgggttccccccacacagcaccatgttccttgtcacctgcttgacactgagtcaaacattgctagaatgtttgcacagcctgagcaccaaaccttgcagtggttctggcagaagaggcatgctgaagagacagctgtgccttccctttggttttcagccctttgatacaatggaggccaaggaattgggattgtcccaggaatctcatgctagggagagaaagaaggaaccttgaagcccagacaatggtgggcaggaccacgccctgattcagactgtttatgtgtaactctgtttaaacttaagcctcctgttggtatcttaaagattaaccgggtgggggcttgaacctttttatattcgaataaacctgctttctctgctaccggtttctttaatggcatgctggggacaggcggctgagcctggcttgttaaggctgtcaccacccaagctctgaccctaagagctctgggaacaaccgggagggatgcctatctggcccacacaccctgggcccaagtatttacctggtagaggggagcaggcacatcgtcattcgggcacaaacctgggatgtcgcccattgtagccactggatatcatcctggatatcagggagccatgtcaccagcctgtggactgcagcgatagccgactccacgggcagactgcagggcagcatgatgtaggacaggatcctgacgggcaggaggttgcagactttgctcaggtagccctccctgtccttaatcgcttcactcagagctgtgctgagctcgggggacagtgtctcccagatgttctcatctgtaaagcataggctgactggcaccttgtctcccacaagtttgccattttccaagcaggcttctggcgccaccaaggacagactcaggctgcgctgtggcccgttacagatgccattctcctccaggaaccggaaggcgtccaggtacccttgatagcacagctctcccatcaccttcacatcagacgggaagagcgctctggtcagaagttggaggttcccagtgcagaggcggaggctgaggttggtgatattcacgtggaagaagttggtggacttgactttggggcagatgtcatgctcaccgtagaaaggtgacaccgtgatggtggttttggcatccagcacagggacgttgtcgctcactcctccgtccacgtaccgctcgcctcggaaggaaggagggattaggccagagaagaggggaatgaagcaggaacacaccagggcatccacgacttcgtctttggaatggaactcagacaccagcacgttctccccatccgacaccctggtgagtgagatgtgaaccttgccagaaatgacctggtggacattgtctgggaggctctcctggagcccgtctctgatgcacttgttaatgttgaagaacgggtggagggtgccgatgttgcggctcctggctttccgcacgaggtccatgaggatctccattatacggccgagagggagactgcacacgaaggtgaccgcgtgcagtgcaccggccgagcagccaaagaaagtgcgcgcatcgcggaggaggtgcggggcgcgctcgctcagacatagcgtagccccgacgtggtagaagcccaggaagccgcagcctgcaaacgacaggctccagcggcgctctgggtcatacatggtgcttgaagctccgggcggcgctgcagttcagctctgctcccggtgttgctgctct

SEQ ID NO: 5 - DNA, 2759 bp, Rattus norvegicus
cccggagcagaattgagctgcatcgccttccggagcctccagcgccatgtacgacccagagcgccgctggagcctgtcgttcgcaggctgcggcttcctaggcttctaccacatcggggctacgctatgtctgagcgagcgcgctccgcacatcctccgcgaagcgcgcactttcttcggctgctcggccggtgcactgcacgcggtcaccttcgtgtgcagtctccctctcgatcacatcatggagatcctcatggacctcgtgcggaaagccaggagccgcaacatcggcaccctccacccgttcttcaacattaacaagtgcgtcagagacggccttcaggagaccctcccagacaacgtccaccagatcatttctggcaaggtttacatctcactcaccagagtgtccgatggggagaacgtgctggtgtctgagttccattccaaagacgaagtggtggatgccctggtgtgctcctgcttcattcctctcttctctggcctaatccctccttccttccgaggtgagcggtacgtggatggaggagtgagtgacaacgtccctgtgctggacgccaaaaccaccatcacggtgtcccctttctatggtgagcatgacatctgtcccaaagtgaagtccaccaacttcctccaggtgaatatcaccaacctcagtcttcgtctctgcactgggaaccttcatcttctgaccagagcactcttcccatctgatgtgaaggtgatgggagagctgtgctttcaagggtacctggacgccttccggttcctggaagagaacggcatctgtaatgggccacagcgcagcctgagtctgtccttggagaaggaaatggcgccagaaaccatgataccctgcttggaaaatggccaccttgtagcagggaacaaggtgccagtaagctgtgtatgccttacagctgtgccgtcggatgagagcatctgggagatgctgtcccccaagctcagcacagctctgactgaagcgattaaagacagggggggctacctgaacaaagtctgcaacctcctgcccattaggatcctgtcctacatcttgctgccctgcactctgcccgtggagtcggccatcgctgcagtccacaggctggtgatgtggctccctgatatccatgaagatatccagtggctacagtgggcaacatcccaggtgtgtgcccgaatgaccatgtgcctgctcccctctaccagatccagagcatccaaggataaccatcaaacactcaagcatggatatcacccatctctccacaaaccccaaggcagctctgccggtttgtaaattgctggtctccgtgcttccgatgaacttgggcattctccctgtggatggttccaggagaggccatagctgaaggcactctgccttccaccccaagtccagtttgacctttatctagagcaacagtgtctagatgataggtgggtggggggtgctgtctctctgtttccctctgggaagggttctgttaacttttggaggcagctaggaaatttctctccaggagctgagcctgtgcagctgcccccttggtgctgtgtggtaacctcattgcctgtgaccctaggatcataggatctgggctaaataggtagttcatagaaaccaaagacaataatttggtgtttagaaaactacttttggtctgggtgaagtctggtgcttgagagttagtgcagagagaacggtcaaaccgtctctcagcctgtggatctatggggattccaagggcttcagtgtttggaaacggcaatccaaacgggcaatcttgtgcaatcttggaaggagaactgttcaggaagtgtgatgggatgagctgtggctgtctctgaaaagggcctaccatataacttattactttcaaggatacctttggctcttactaaaatagtttataaagcattttatagaaacacaccagggaatgcgtggtgaactacatgtatgatcagtgaactgtgactagaattaaccttaaaatctcttgtatgtggggccagagcaacacaggtgggaaacgcagcggacctctgcctcctcggcctcaacatgaacttggcttgctttctccaccgtctccaaatctttgtatagtcatcgaccattaccacctctcctttcccatctactacagcagccttaatggggataagtacccccttttctcaggtgtccgaataagctgtgggtgtggcctgtgtttcctgtaattctgaggttagattggaacataagcaagcagacaaacaagcagacaaacaaacaaggttctactcatattcctaagcagtgacagtgaaggcatgtgtctcccatgcctgagtctcctagggtcctagtgagctctgggttcatgcaagcacttccggaggaattgcaccctccatggaacacataatctccactgggttgatcctgattggataagaaaggatctcggggagagaatgtggttccagaggcaaagtgtctaggctacacagaaaaggtaagactgtccccaagggaagaaaacaaactgggagctggggtccagctcaattgttaagagtgcttctctagtatgcgtgaagcccagagtccaatctcagtaccagatacacggtacaggcagtgacatatgcctgtaatcccaaccctcaagcagtagaggcaagaggatcagaagttcatggtcatccttgactacttatacttagggagttggaggtcagcc

SEQ ID NO: 6 - DNA, 2759 bp, Rattus norvegicus
ggctgacctccaactccctaagtataagtagtcaaggatgaccatgaacttctgatcctcttgcctctactgcttgagggttgggattacaggcatatgtcactgcctgtaccgtgtatctggtactgagattggactctgggcttcacgcatactagagaagcactcttaacaattgagctggaccccagctcccagtttgttttcttcccttggggacagtcttaccttttctgtgtagcctagacactttgcctctggaaccacattctctccccgagatcctttcttatccaatcaggatcaacccagtggagattatgtgttccatggagggtgcaattcctccggaagtgcttgcatgaacccagagctcactaggaccctaggagactcaggcatgggagacacatgccttcactgtcactgcttaggaatatgagtagaaccttgtttgtttgtctgcttgtttgtctgcttgcttatgttccaatctaacctcagaattacaggaaacacaggccacacccacagcttattcggacacctgagaaaagggggtacttatccccattaaggctgctgtagtagatgggaaaggagaggtggtaatggtcgatgactatacaaagatttggagacggtggagaaagcaagccaagttcatgttgaggccgaggaggcagaggtccgctgcgtttcccacctgtgttgctctggccccacatacaagagattttaaggttaattctagtcacagttcactgatcatacatgtagttcaccacgcattccctggtgtgtttctataaaatgctttataaactattttagtaagagccaaaggtatccttgaaagtaataagttatatggtaggcccttttcagagacagccacagctcatcccatcacacttcctgaacagttctccttccaagattgcacaagattgcccgtttggattgccgtttccaaacactgaagcccttggaatccccatagatccacaggctgagagacggtttgaccgttctctctgcactaactctcaagcaccagacttcacccagaccaaaagtagttttctaaacaccaaattattgtctttggtttctatgaactacctatttagcccagatcctatgatcctagggtcacaggcaatgaggttaccacacagcaccaagggggcagctgcacaggctcagctcctggagagaaatttcctagctgcctccaaaagttaacagaacccttcccagagggaaacagagagacagcaccccccacccacctatcatctagacactgttgctctagataaaggtcaaactggacttggggtggaaggcagagtgccttcagctatggcctctcctggaaccatccacagggagaatgcccaagttcatcggaagcacggagaccagcaatttacaaaccggcagagctgccttggggtttgtggagagatgggtgatatccatgcttgagtgtttgatggttatccttggatgctctggatctggtagaggggagcaggcacatggtcattcgggcacacacctgggatgttgcccactgtagccactggatatcttcatggatatcagggagccacatcaccagcctgtggactgcagcgatggccgactccacgggcagagtgcagggcagcaagatgtaggacaggatcctaatgggcaggaggttgcagactttgttcaggtagccccccctgtctttaatcgcttcagtcagagctgtgctgagcttgggggacagcatctcccagatgctctcatccgacggcacagctgtaaggcatacacagcttactggcaccttgttccctgctacaaggtggccattttccaagcagggtatcatggtttctggcgccatttccttctccaaggacagactcaggctgcgctgtggcccattacagatgccgttctcttccaggaaccggaaggcgtccaggtacccttgaaagcacagctctcccatcaccttcacatcagatgggaagagtgctctggtcagaagatgaaggttcccagtgcagagacgaagactgaggttggtgatattcacctggaggaagttggtggacttcactttgggacagatgtcatgctcaccatagaaaggggacaccgtgatggtggttttggcgtccagcacagggacgttgtcactcactcctccatccacgtaccgctcacctcggaaggaaggagggattaggccagagaagagaggaatgaagcaggagcacaccagggcatccaccacttcgtctttggaatggaactcagacaccagcacgttctccccatcggacactctggtgagtgagatgtaaaccttgccagaaatgatctggtggacgttgtctgggagggtctcctgaaggccgtctctgacgcacttgttaatgttgaagaacgggtggagggtgccgatgttgcggctcctggctttccgcacgaggtccatgaggatctccatgatgtgatcgagagggagactgcacacgaaggtgaccgcgtgcagtgcaccggccgagcagccgaagaaagtgcgcgcttcgcggaggatgtgcggagcgcgctcgctcagacatagcgtagccccgatgtggtagaagcctaggaagccgcagcctgcgaacgacaggctccagcggcgctctgggtcgtacatggcgctggaggctccggaaggcgatgcagctcaattctgctccggg

SEQ ID NO: 7 - DNA, 2281 bp, Macaca fascicularis
tgctgcggatcaggacccgagccgatccccgatcccgactccgatccggatccgcgcccccgcccccgccccgccatgtacgacgccgagcgcggctggagcttgtccttcgcgggctgcggcttcctgggcttctaccacgtcggggcgacccggtgcctgagcgagcacgccccgcacctcctccgcgacgcgcgcatgttgttcggcgcctcggccggggcgttgcactgcgtcggcgtcctctccgggatcccgctggagcagactctgcaggtcctctcagatcttgtccggaaggccaggagtcggaacattggtatcttccatccatccttcaacataggcaagttcctccgacaggatctctacaaatacctcccggccaatgtccaccagctcatctctggcaaaatatgcgtctcactcaccagagtgtctgatggggaaaacgttctggtgtctgactttcagtccaaagacgaagtcgtggatgccttgatttgttcctgcttcatccctttctacagtggccttatccctccttccttcagaggcgtgcgatatgtggatggaggagcgagtgacaacgtacccttcattgatgccaagacaaccatcaccgtgtcgcccttctatggggagtacgacatctgccctaaagtcaagtccaccaactttcttcatgtggacatcaccaagctcagcctacgcctctgcacagggaacctctaccttctctcaagagcgtttgtccccccggatctcaaggtgctgggagagatatgccttcgaggatatttggacgcgttcaggttcttggaagagaagggcatctgcaacaagccccagcggggtctgaagtcatcctcagaagggatggattctgaggtcactgcgcccggctgggaaaacacaagtctggattcttccccggagccggctgccttggctatgaggctggatggagatgagctgctagaccacctgcgtctcagcatcctgccctgggatgagagcatcctggacaccctgtcgcccgagctcgctacagcagtgagtgaagcaatgaaagacaaaggtggatacatgagcaagatttgcaacttgctacccattaggataatatcttatgtgatgctgccctgtaccctgcctgtggagtctgccattgcgattgtccagagactggtgacatggcttccagatatgcccgacgatgtgcagtggctgcagtgggtgacctcacaggtcttcactcgagcgctgatgtgtctgcttcccgcctccaggtcccaaatgccagtgagcagcgaacaggcctccccatgcaaaccggagcaggactggcactgctggactccctgctcccccgaggactgtcctgcagaggccaaagcagaggctaccccacggtccatcctcaggtccagcctgaacttcttctggggcaataaagtacctgctggtgctgaggggctctccacctttcccagtttttcactggagaagaatttgtgagtcatttgaggaggcgagtctaggagattctttcagaggtgctaaagcttcccatctttgtgcagctacctccgcattgccgtgtagtgacccctgcctgtgacgtggaggatcccagcctctgagctgagttggttttatgaaaagctaggaagcaatgtttggtctgtgcagcagtccagcacttaagtctaatacgtcagcatgcgttagttcagctggttgggaaatgacaccgggaagcctagcgcagagggtcccttactgactatttcatggtcctattaatggtcagactgttccagtgtgaggttcttagaatgactagtgtttggatgggtgggggccttgtggtggggggtgggctggcctatgtgtgatcttgtggggtggaaggaagagagtagcacaatcccacctccccatgccgtgggaaggggtgcacttggttcccaagaaggacactgcctgtcaggtggcctgcaaatataataaccttgacaactaaaaacctctccatgggggtgggaggtaccaagataataaccgatttacattttagagcacctttttcacctaactaaaataatgtttaaagagttttatataaaaatgtaaggaagagttgttatctgttgaattttgtattatatgaatcagtgagatgttaatagaataagcctttaaaaagaaaaaaagttcagccaggcgctgtggcacacgcctgtaatcccagcactttggaaggccgaggtgggca

SEQ ID NO: 8 - DNA, 2281 bp, Macaca fascicularis
tgcccacctcggccttccaaagtgctgggattacaggcgtgtgccacagcgcctggctgaactttttttctttttaaaggcttattctattaacatctcactgattcatataatacaaaattcaacagataacaactcttccttacatttttatataaaactctttaaacattattttagttaggtgaaaaaggtgctctaaaatgtaaatcggttattatcttggtacctcccacccccatggagaggtttttagttgtcaaggttattatatttgcaggccacctgacaggcagtgtccttcttgggaaccaagtgcaccccttcccacggcatggggaggtgggattgtgctactctcttccttccaccccacaagatcacacataggccagcccaccccccaccacaaggcccccacccatccaaacactagtcattctaagaacctcacactggaacagtctgaccattaataggaccatgaaatagtcagtaagggaccctctgcgctaggcttcccggtgtcatttcccaaccagctgaactaacgcatgctgacgtattagacttaagtgctggactgctgcacagaccaaacattgcttcctagcttttcataaaaccaactcagctcagaggctgggatcctccacgtcacaggcaggggtcactacacggcaatgcggaggtagctgcacaaagatgggaagctttagcacctctgaaagaatctcctagactcgcctcctcaaatgactcacaaattcttctccagtgaaaaactgggaaaggtggagagcccctcagcaccagcaggtactttattgccccagaagaagttcaggctggacctgaggatggaccgtggggtagcctctgctttggcctctgcaggacagtcctcgggggagcagggagtccagcagtgccagtcctgctccggtttgcatggggaggcctgttcgctgctcactggcatttgggacctggaggcgggaagcagacacatcagcgctcgagtgaagacctgtgaggtcacccactgcagccactgcacatcgtcgggcatatctggaagccatgtcaccagtctctggacaatcgcaatggcagactccacaggcagggtacagggcagcatcacataagatattatcctaatgggtagcaagttgcaaatcttgctcatgtatccacctttgtctttcattgcttcactcactgctgtagcgagctcgggcgacagggtgtccaggatgctctcatcccagggcaggatgctgagacgcaggtggtctagcagctcatctccatccagcctcatagccaaggcagccggctccggggaagaatccagacttgtgttttcccagccgggcgcagtgacctcagaatccatcccttctgaggatgacttcagaccccgctggggcttgttgcagatgcccttctcttccaagaacctgaacgcgtccaaatatcctcgaaggcatatctctcccagcaccttgagatccggggggacaaacgctcttgagagaaggtagaggttccctgtgcagaggcgtaggctgagcttggtgatgtccacatgaagaaagttggtggacttgactttagggcagatgtcgtactccccatagaagggcgacacggtgatggttgtcttggcatcaatgaagggtacgttgtcactcgctcctccatccacatatcgcacgcctctgaaggaaggagggataaggccactgtagaaagggatgaagcaggaacaaatcaaggcatccacgacttcgtctttggactgaaagtcagacaccagaacgttttccccatcagacactctggtgagtgagacgcatattttgccagagatgagctggtggacattggccgggaggtatttgtagagatcctgtcggaggaacttgcctatgttgaaggatggatggaagataccaatgttccgactcctggccttccggacaagatctgagaggacctgcagagtctgctccagcgggatcccggagaggacgccgacgcagtgcaacgccccggccgaggcgccgaacaacatgcgcgcgtcgcggaggaggtgcggggcgtgctcgctcaggcaccgggtcgccccgacgtggtagaagcccaggaagccgcagcccgcgaaggacaagctccagccgcgctcggcgtcgtacatggcggggcgggggcgggggcgcggatccggatcggagtcgggatcggggatcggctcgggtcctgatccgcagca

SEQ ID NO: 9 - DNA, 1544 bp, Macaca mulatta
cgcttgcgggcgcccggcggagctgctgcggatcaggacccgagccgatccccgatcccgactccgatccggatccgcgcccccgcccccgccccgccatgtacgacgccgagcgcggctggagcttgtccttcgcgggctgcggcttcctgggcttctaccacgtcggggcgacccgctgcctgagcgagcacgccccgcacctcctccgcgacgcgcgcatgttgttcggcgcctcggccggggcgttgcactgcgtcggcgtcctctccgggatcccgctggagcagactctgcaggtcctctcagatcttgtccggaaggccaggagtcggaacattggtatcttccatccatccttcaacataggcaagttcctccgacaggatctctacaaatacctcccggccaatgtccaccagctcatctctggcaaaatatgcgtctcactcaccagagtgtctgatggggaaaacgttctggtgtctgactttcagtccaaagacgaagtcgtggatgccttgatttgttcctgcttcatccctttctacagtggccttatccctccttccttcagaggcgtgcgatatgtggatggaggagcgagtgacaacgtacccttcattgatgccaagacaaccatcaccgtgtcgcccttctatggggagtacgacatctgccctaaagtcaagtccaccaactttcttcatgtggacatcaccaagctcagcctacgcctctgcacagggaacctctaccttctctcaagagcgtttgtccccccggatctcaaggtgctgggagagatatgccttcgaggatatttggacgcgttcaggttcttggaagagaagggcatctgcaacaagccccagcggggtctgaagtcatcctcagaagggatggattctgaggtcactgcgcccggctgggaaaacacaagtctggattcttccccggagccggctgccttggctatgaggctggatggagatgagctgctagaccacctgcgtctcagcatcctgccctgggatgagagcatcctggacaccctgtcgcccgagctcgctacagcagtgagtgaagcaatgaaagacaaaggtggatacatgagcaagatttgcaacttgctacccattaggataatgtcttatgtgatgctgccctgtaccctgcctgtggagtctgccattgcgattgtccagagactggtgacatggcttccggatatgcccgacgatgtgcagtggctgcagtgggtgacctcacaggtcttcactcgagcgctgatgtgtctgcttcccgcctccaggtcccaaatgccagtgagcggcgaacaggcctccccatgcaaaccggagcaggactggcactgctggactccctgctcccccgaggactgtcctgcagaggccaaagcagaggctaccccacggtccatcctcaggtccagcctgaacttcttctggggcaataaagtacctgctggtgctgaggggctctccacctttcccagtttttcactggagaagaatttgtga

SEQ ID NO: 10 - DNA, 1544 bp, Macaca mulatta
tcacaaattcttctccagtgaaaaactgggaaaggtggagagcccctcagcaccagcaggtactttattgccccagaagaagttcaggctggacctgaggatggaccgtggggtagcctctgctttggcctctgcaggacagtcctcgggggagcagggagtccagcagtgccagtcctgctccggtttgcatggggaggcctgttcgccgctcactggcatttgggacctggaggcgggaagcagacacatcagcgctcgagtgaagacctgtgaggtcacccactgcagccactgcacatcgtcgggcatatccggaagccatgtcaccagtctctggacaatcgcaatggcagactccacaggcagggtacagggcagcatcacataagacattatcctaatgggtagcaagttgcaaatcttgctcatgtatccacctttgtctttcattgcttcactcactgctgtagcgagctcgggcgacagggtgtccaggatgctctcatcccagggcaggatgctgagacgcaggtggtctagcagctcatctccatccagcctcatagccaaggcagccggctccggggaagaatccagacttgtgttttcccagccgggcgcagtgacctcagaatccatcccttctgaggatgacttcagaccccgctggggcttgttgcagatgcccttctcttccaagaacctgaacgcgtccaaatatcctcgaaggcatatctctcccagcaccttgagatccggggggacaaacgctcttgagagaaggtagaggttccctgtgcagaggcgtaggctgagcttggtgatgtccacatgaagaaagttggtggacttgactttagggcagatgtcgtactccccatagaagggcgacacggtgatggttgtcttggcatcaatgaagggtacgttgtcactcgctcctccatccacatatcgcacgcctctgaaggaaggagggataaggccactgtagaaagggatgaagcaggaacaaatcaaggcatccacgacttcgtctttggactgaaagtcagacaccagaacgttttccccatcagacactctggtgagtgagacgcatattttgccagagatgagctggtggacattggccgggaggtatttgtagagatcctgtcggaggaacttgcctatgttgaaggatggatggaagataccaatgttccgactcctggccttccggacaagatctgagaggacctgcagagtctgctccagcgggatcccggagaggacgccgacgcagtgcaacgccccggccgaggcgccgaacaacatgcgcgcgtcgcggaggaggtgcggggcgtgctcgctcaggcagcgggtcgccccgacgtggtagaagcccaggaagccgcagcccgcgaaggacaagctccagccgcgctcggcgtcgtacatggcggggcgggggcgggggcgcggatccggatcggagtcgggatcggggatcggctcgggtcctgatccgcagcagctccgccgggcgcccgcaagcg

SEQ ID NO: 11 - DNA, 1495 bp, Macaca fascicularis
gctgctgcggatcaggacccgagccgatccccgatcccgactccgatccggatccgcgcccccgcccccgccccgccatgtacgacgccgagcgcggctggagcttgtccttcgcgggctgcggcttcctgggcttctaccacgtcggggcgacccggtgcctgagcgagcacgccccgcacctcctccgcgacgcgcgcatgttgttcggcgcctcggccggggcgttgcactgcgtcggcgtcctctccgggatcccgctggagcagactctgcaggtcctctcagatcttgtccggaaggccaggagtcggaacattggtatcttccatccatccttcaacataggcaagttcctccgacaggatctctacaaatacctcccggccaatgtccaccagctcatctctggcaaaatatgcgtctcactcaccagagtgtctgatggggaaaacgttctggtgtctgactttcagtccaaagacgaagtcgtggatgccttgatttgttcctgcttcatccctttctacagtggccttatccctccttccttcagaggcgtgcgatatgtggatggaggagcgagtgacaacgtacccttcattgatgccaagacaaccatcaccgtgtcgcccttctatggggagtacgacatctgccctaaagtcaagtccaccaactttcttcatgtggacatcaccaagctcagcctacgcctctgcacagggaacctctaccttctctcaagagcgtttgtccccccggatctcaaggtgctgggagagatatgccttcgaggatatttggacgcgttcaggttcttggaagagaagggcatctgcaacaagccccagcggggtctgaagtcatcctcagaagggatggattctgaggtcactgcgcccggctgggaaaacacaagtctggattcttccccggagccggctgccttggctatgaggctggatggagatgagctgctagaccacctgcgtctcagcatcctgccctgggatgagagcatcctggacaccctgtcgcccgagctcgctacagcagtgagtgaagcaatgaaagacaaaggtggatacatgagcaagatttgcaacttgctacccattaggataatatcttatgtgatgctgccctgtaccctgcctgtggagtctgccattgcgattgtccagagtgtaagtcctttgagctttcttgaaccagaagtggcctcattttgctttagagatttcagatgggctcatccttgtcctgtcatcccagatccacctgctgggaagtcatcagattggagatgatgttggcggcttttgtaaacaaagggtggtgttgtaagctgttgtgtctgcctgtgtgtgtgtttgtgtacttggtcttatctctgcagactggtgacatggcttccagatatgcccgacgatgtgcagtggctgcagtgggtgacctcacaggtcttcactcgagcgctgatgtgtctgct

SEQ ID NO: 12 - DNA, 1495 bp, Macaca fascicularis
agcagacacatcagcgctcgagtgaagacctgtgaggtcacccactgcagccactgcacatcgtcgggcatatctggaagccatgtcaccagtctgcagagataagaccaagtacacaaacacacacacaggcagacacaacagcttacaacaccaccctttgtttacaaaagccgccaacatcatctccaatctgatgacttcccagcaggtggatctgggatgacaggacaaggatgagcccatctgaaatctctaaagcaaaatgaggccacttctggttcaagaaagctcaaaggacttacactctggacaatcgcaatggcagactccacaggcagggtacagggcagcatcacataagatattatcctaatgggtagcaagttgcaaatcttgctcatgtatccacctttgtctttcattgcttcactcactgctgtagcgagctcgggcgacagggtgtccaggatgctctcatcccagggcaggatgctgagacgcaggtggtctagcagctcatctccatccagcctcatagccaaggcagccggctccggggaagaatccagacttgtgttttcccagccgggcgcagtgacctcagaatccatcccttctgaggatgacttcagaccccgctggggcttgttgcagatgcccttctcttccaagaacctgaacgcgtccaaatatcctcgaaggcatatctctcccagcaccttgagatccggggggacaaacgctcttgagagaaggtagaggttccctgtgcagaggcgtaggctgagcttggtgatgtccacatgaagaaagttggtggacttgactttagggcagatgtcgtactccccatagaagggcgacacggtgatggttgtcttggcatcaatgaagggtacgttgtcactcgctcctccatccacatatcgcacgcctctgaaggaaggagggataaggccactgtagaaagggatgaagcaggaacaaatcaaggcatccacgacttcgtctttggactgaaagtcagacaccagaacgttttccccatcagacactctggtgagtgagacgcatattttgccagagatgagctggtggacattggccgggaggtatttgtagagatcctgtcggaggaacttgcctatgttgaaggatggatggaagataccaatgttccgactcctggccttccggacaagatctgagaggacctgcagagtctgctccagcgggatcccggagaggacgccgacgcagtgcaacgccccggccgaggcgccgaacaacatgcgcgcgtcgcggaggaggtgcggggcgtgctcgctcaggcaccgggtcgccccgacgtggtagaagcccaggaagccgcagcccgcgaaggacaagctccagccgcgctcggcgtcgtacatggcggggcgggggcgggggcgcggatccggatcggagtcgggatcggggatcggctcgggtcctgatccgcagcagc

SEQ ID NO: 13 - DNA, 2821 bp, Artificial Sequence
  source: /note="Description of Artificial Sequence: Synthetic polynucleotide"
gcgatcgcatggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagacgcggccgc

SEQ ID NO: 14 - protein, 16 aa, Unknown
  source: /note="Description of Unknown: RFGF peptide"
AAVALLPAVLLALLAP

SEQ ID NO: 15 - protein, 11 aa, Unknown
  source: /note="Description of Unknown: RFGF analogue peptide"
AALLPVLLAAP

SEQ ID NO: 16 - protein, 13 aa, Human immunodeficiency virus
GRKKRRQRRRPPQ

SEQ ID NO: 17 - protein, 16 aa, Drosophila sp.
RQIKIWFQNRRMKWKK

SEQ ID NO: 18 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuacgcugaguacuucgatt

SEQ ID NO: 19 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaaguacucagcguaagtt

SEQ ID NO: 20 - RNA, 21 nt, Artificial Sequence
  source: /note="Description of Artificial Sequence: Synthetic oligonucleotide"
caugagcaagauuugcaacuu

SEQ ID NO: 21 - RNA, 21 nt, Artificial Sequence
  source: /note="Description of Artificial Sequence: Synthetic oligonucleotide"
ugaugccaaaacaaccaucau

SEQ ID NO: 22 - RNA, 21 nt, Artificial Sequence
  source: /note="Description of Artificial Sequence: Synthetic oligonucleotide"
aaagacgaagucguggaugcu

SEQ ID NO: 23 - RNA, 21 nt, Artificial Sequence
  source: /note="Description of Artificial Sequence: Synthetic oligonucleotide"
gguggauacaugagcaagauu

SEQ ID NO: 24 - RNA, 21 nt, Artificial Sequence
  source: /note="Description of Artificial Sequence: Synthetic oligonucleotide"
uccagauaugcccgacgaugu

SEQ ID NO: 25 - RNA, 21 nt, Artificial Sequence
  source: /note="Description of Artificial Sequence: Synthetic oligonucleotide"
aacuugcuacccauuaggauu

SEQ ID NO: 26 - RNA, 21 nt, Artificial Sequence
  source: /note="Description of Artificial Sequence: Synthetic oligonucleotide"
ucgguccaaagacgaagucgu

SEQ ID NO: 27 - RNA, 21 nt, Artificial Sequence
  source: /note="Description of Artificial Sequence: Synthetic oligonucleotide"
acuugcuacccauuaggauau

SEQ ID NO: 28 - RNA, 21 nt, Artificial Sequence
  source: /note="Description of Artificial Sequence: Synthetic oligonucleotide"
cuuaagcaaguuccuccgacu

SEQ ID NO: 29 - RNA, 21 nt, Artificial Sequence
  source: /note="Description of Artificial Sequence: Synthetic oligonucleotide"
cugggagagauaugccuucgu

SEQ ID NO: 30 - RNA, 21 nt, Artificial Sequence
  source: /note="Description of Artificial Sequence: Synthetic oligonucleotide"
ucccaucuuugugcagcuacu

SEQ ID NO: 31 - RNA, 21 nt, Artificial Sequence
  source: /note="Description of Artificial Sequence: Synthetic oligonucleotide"
cugacuuucgguccaaagacu

SEQ ID NO: 32 - RNA, 21 nt, Artificial Sequence
  source: /note="Description of Artificial Sequence: Synthetic oligonucleotide"
acaccuuuuucaccuaacuau

SEQ ID NO: 33 - RNA, 21 nt, Artificial Sequence
  source: /note="Description of Artificial Sequence: Synthetic oligonucleotide"
gugagugacaacguacccuuu

SEQ ID NO: 34 - RNA, 21 nt, Artificial Sequence
  source: /note="Description of Artificial Sequence: Synthetic oligonucleotide"
caagcucagucuacgccucuu

SEQ ID NO: 35 - RNA, 21 nt, Artificial Sequence
  source: /note="Description of Artificial Sequence: Synthetic oligonucleotide"
ugggagagauaugccuucgau

SEQ ID NO: 36 - RNA, 21 nt, Artificial Sequence
  source: /note="Description of Artificial Sequence: Synthetic oligonucleotide"
gagauaugccuucgaggauau

SEQ ID NO: 37 - RNA, 21 nt, Artificial Sequence
  source: /note="Description of Artificial Sequence: Synthetic oligonucleotide"
guggaaucugccauugcgauu

SEQ ID NO: 38 - RNA, 21 nt, Artificial Sequence
  source: /note="Description of Artificial Sequence: Synthetic oligonucleotide"
ugagugacaacguacccuucu

SEQ ID NO: 39 - RNA, 21 nt, Artificial Sequence
  source: /note="Description of Artificial Sequence: Synthetic oligonucleotide"
cuugcuacccauuaggauaau

SEQ ID NO: 40 - RNA, 21 nt, Artificial Sequence
  source: /note="Description of Artificial Sequence: Synthetic oligonucleotide"
guggauacaugagcaagauuu

SEQ ID NO: 41 - RNA, 21 nt, Artificial Sequence
  source: /note="Description of Artificial Sequence: Synthetic oligonucleotide"
auugcgauuguccagagacuu

SEQ ID NO: 42 - RNA, 21 nt, Artificial Sequence
  source: /note="Description of Artificial Sequence: Synthetic oligonucleotide"
gccauugcgauuguccagagu

SEQ ID NO: 43 - RNA, 21 nt, Artificial Sequence
  source: /note="Description of Artificial Sequence: Synthetic oligonucleotide"
gaggagugagugacaacguau

SEQ ID NO: 44 - RNA, 21 nt, Artificial Sequence
  source: /note="Description of Artificial Sequence: Synthetic oligonucleotide"
agugagugacaacguacccuu

SEQ ID NO: 45 - RNA, 21 nt, Artificial Sequence
  source: /note="Description of Artificial Sequence: Synthetic oligonucleotide"
ggagugagugacaacguaccu

SEQ ID NO: 46 - RNA, 21 nt, Artificial Sequence
  source: /note="Description of Artificial Sequence: Synthetic oligonucleotide"
uugggcaauaaaguaccugcu

SEQ ID NO: 47 - RNA, 21 nt, Artificial Sequence
  source: /note="Description of Artificial Sequence: Synthetic oligonucleotide"
augcguuaauucagcugguuu

SEQ ID NO: 48 - RNA, 21 nt, Artificial Sequence
  source: /note="Description of Artificial Sequence: Synthetic oligonucleotide"
cagggaaccucuaccuucucu

SEQ ID NO: 49 - RNA, 21 nt, Artificial Sequence
  source: /note="Description of Artificial Sequence: Synthetic oligonucleotide"
ugccauugcgauuguccagau

SEQ ID NO: 50 - RNA, 21 nt, Artificial Sequence
  source: /note="Description of Artificial Sequence: Synthetic oligonucleotide"
cauugcgauuguccagagacu

SEQ ID NO: 51 - RNA, 21 nt, Artificial Sequence
  source: /note="Description of Artificial Sequence: Synthetic oligonucleotide"
caaagacgaagucguggaugu

SEQ ID NO: 52 - RNA, 21 nt, Artificial Sequence
  source: /note="Description of Artificial Sequence: Synthetic oligonucleotide"
cuuucgguccaaagacgaagu

SEQ ID NO: 53 - RNA, 21 nt, Artificial Sequence
  source: /note="Description of Artificial Sequence: Synthetic oligonucleotide"
cgguccaaagacgaagucguu

SEQ ID NO: 54 - RNA, 21 nt, Artificial Sequence
  source: /note="Description of Artificial Sequence: Synthetic oligonucleotide"
agagauaugccuucgaggauu

SEQ ID NO: 55 - RNA, 21 nt, Artificial Sequence
  source: /note="Description of Artificial Sequence: Synthetic oligonucleotide"
aggagugagugacaacguacu

SEQ ID NO: 56 - RNA, 21 nt, Artificial Sequence
  source: /note="Description of Artificial Sequence: Synthetic oligonucleotide"
aucugcccuaaagucaagucu

SEQ ID NO: 57 - RNA, 21 nt, Artificial Sequence
  source: /note="Description of Artificial Sequence: Synthetic oligonucleotide"
cuucuacaguggccuuauccu

SEQ ID NO: 58 - RNA, 21 nt, Artificial Sequence
  source: /note="Description of Artificial Sequence: Synthetic oligonucleotide"
caugcguuaauucagcugguu

SEQ ID NO: 59 - RNA, 21 nt, Artificial Sequence
  source: /note="Description of Artificial Sequence: Synthetic oligonucleotide"
uccaaagacgaagucguggau

SEQ ID NO: 60 - RNA, 21 nt, Artificial Sequence
  source: /note="Description of Artificial Sequence: Synthetic oligonucleotide"
guggcccuauuaauggucagu

SEQ ID NO: 61 - RNA, 21 nt, Artificial Sequence
  source: /note="Description of Artificial Sequence: Synthetic oligonucleotide"
ugcugggagagauaugccuuu

SEQ ID NO: 62 - RNA, 21 nt, Artificial Sequence
  source: /note="Description of Artificial Sequence: Synthetic oligonucleotide"
ucagcugguugggaaaugacu

SEQ ID NO: 63 - RNA, 21 nt, Artificial Sequence
  source: /note="Description of Artificial Sequence: Synthetic oligonucleotide"
uugcuacccauuaggauaauu

SEQ ID NO: 64 - RNA, 21 nt, Artificial Sequence
  source: /note="Description of Artificial Sequence: Synthetic oligonucleotide"
agauaugccuucgaggauauu

SEQ ID NO: 65 - RNA, 21 nt, Artificial Sequence
  source: /note="Description of Artificial Sequence: Synthetic oligonucleotide"
gcugggagagauaugccuucu

SEQ ID NO: 66 - RNA, 21 nt, Artificial Sequence
  source: /note="Description of Artificial Sequence: Synthetic oligonucleotide"
uuaauggucagacuguuccau

SEQ ID NO: 67 - RNA, 21 nt, Artificial Sequence
  source: /note="Description of Artificial Sequence: Synthetic oligonucleotide"
gguccaaagacgaagucgugu

SEQ ID NO: 68 - RNA, 21 nt, Artificial Sequence
  source: /note="Description of Artificial Sequence: Synthetic oligonucleotide"
gauaugccuucgaggauauuu

SEQ ID NO: 69 - RNA, 21 nt, Artificial Sequence
  source: /note="Description of Artificial Sequence: Synthetic oligonucleotide"
gcugguugggaaaugacaccu

SEQ ID NO: 70 - RNA, 21 nt, Artificial Sequence
  source: /note="Description of Artificial Sequence: Synthetic oligonucleotide"
uucuacaguggccuuaucccu

SEQ ID NO: 71 - RNA, 21 nt, Artificial Sequence
  source: /note="Description of Artificial Sequence: Synthetic oligonucleotide"
uauuaauggucagacuguucu

SEQ ID NO: 72 - RNA, 21 nt, Artificial Sequence
  source: /note="Description of Artificial Sequence: Synthetic oligonucleotide"
uucgguccaaagacgaagucu

SEQ ID NO: 73 - RNA, 21 nt, Artificial Sequence
  source: /note="Description of Artificial Sequence: Synthetic oligonucleotide"
uuccagauaugcccgacgauu

SEQ ID NO: 74 - RNA, 21 nt, Artificial Sequence
  source: /note="Description of Artificial Sequence: Synthetic oligonucleotide"
uuuagaacaccuuuuucaccu

SEQ ID NO: 75 - RNA, 21 nt, Artificial Sequence
  source: /note="Description of Artificial Sequence: Synthetic oligonucleotide"
gcacagggaaccucuaccuuu

SEQ ID NO: 76 - RNA, 21 nt, Artificial Sequence
  source: /note="Description of Artificial Sequence: Synthetic oligonucleotide"
gagagauaugccuucgaggau

SEQ ID NO: 77 - RNA, 21 nt, Artificial Sequence
  source: /note="Description of Artificial Sequence: Synthetic oligonucleotide"
ucugcccuaaagucaaguccu

SEQ ID NO: 78 - RNA, 21 nt, Artificial Sequence
  source: /note="Description of Artificial Sequence: Synthetic oligonucleotide"
caacuugcuacccauuaggau

SEQ ID NO: 79 - RNA, 21 nt, Artificial Sequence
  source: /note="Description of Artificial Sequence: Synthetic oligonucleotide"
gagugagugacaacguacccu

SEQ ID NO: 80 - RNA, 21 nt, Artificial Sequence
  source: /note="Description of Artificial Sequence: Synthetic oligonucleotide"
gacuuucgguccaaagacgau

SEQ ID NO: 81 - RNA, 21 nt, Artificial Sequence
  source: /note="Description of Artificial Sequence: Synthetic oligonucleotide"
ggccaggagucggaacauugu

SEQ ID NO: 82 - RNA, 21 nt, Artificial Sequence
  source: /note="Description of Artificial Sequence: Synthetic oligonucleotide"
uuucgguccaaagacgaaguu

SEQ ID NO: 83 - RNA, 21 nt, Artificial Sequence
  source: /note="Description of Artificial Sequence: Synthetic oligonucleotide"
aaucugccauugcgauugucu

SEQ ID NO: 84 - RNA, 21 nt, Artificial Sequence
  source: /note="Description of Artificial Sequence: Synthetic oligonucleotide"
cagagggucccuuacugacuu

SEQ ID NO: 85 - RNA, 21 nt, Artificial Sequence
  source: /note="Description of Artificial Sequence: Synthetic oligonucleotide"
uugguuuuaugaaaagcuagu

SEQ ID NO: 86 - RNA, 21 nt, Artificial Sequence
  source: /note="Description of Artificial Sequence: Synthetic oligonucleotide"
uggcccuauuaauggucagau

SEQ ID NO: 87 - RNA, 21 nt, Artificial Sequence
  source: /note="Description of Artificial Sequence: Synthetic oligonucleotide"
agugacaacguacccuucauu

SEQ ID NO: 88 - RNA, 21 nt, Artificial Sequence
  source: /note="Description of Artificial Sequence: Synthetic oligonucleotide"
auuaauggucagacuguuccu

SEQ ID NO: 89 - RNA, 21 nt, Artificial Sequence
  source: /note="Description of Artificial Sequence: Synthetic oligonucleotide"
gugcagcuaccuccgcauugu

SEQ ID NO: 90 - RNA, 21 nt, Artificial Sequence
  source: /note="Description of Artificial Sequence: Synthetic oligonucleotide"
gccaaaacaaccaucaccguu

SEQ ID NO: 91 - RNA, 21 nt, Artificial Sequence
  source: /note="Description of Artificial Sequence: Synthetic oligonucleotide"
aacguucuggugucugacuuu

SEQ ID NO: 92 - RNA, 21 nt, Artificial Sequence
  source: /note="Description of Artificial Sequence: Synthetic oligonucleotide"
uuaagcaaguuccuccgacau

SEQ ID NO: 93 - RNA, 21 nt, Artificial Sequence
  source: /note="Description of Artificial Sequence: Synthetic oligonucleotide"
caacguacccuucauugaugu

SEQ ID NO: 94 - RNA, 21 nt, Artificial Sequence
  source: /note="Description of Artificial Sequence: Synthetic oligonucleotide"
ugacaacguacccuucauugu

SEQ ID NO: 95 - RNA, 21 nt, Artificial Sequence
  source: /note="Description of Artificial Sequence: Synthetic oligonucleotide"
cccuauuaauggucagacugu

SEQ ID NO: 96 - RNA, 21 nt, Artificial Sequence
  source: /note="Description of Artificial Sequence: Synthetic oligonucleotide"
ugacuuucgguccaaagacgu

SEQ ID NO: 97 - RNA, 21 nt, Artificial Sequence
  source: /note="Description of Artificial Sequence: Synthetic oligonucleotide"
gacaaagguggauacaugagu

SEQ ID NO: 98 - RNA, 21 nt, Artificial Sequence
  source: /note="Description of Artificial Sequence: Synthetic oligonucleotide"
acuuucgguccaaagacgaau

SEQ ID NO: 99 - RNA, 21 nt, Artificial Sequence
  source: /note="Description of Artificial Sequence: Synthetic oligonucleotide"
cgcauugcuguguagugaccu

SEQ ID NO: 100 - RNA, 21 nt, Artificial Sequence
  source: /note="Description of Artificial Sequence: Synthetic oligonucleotide"
ucuaauacaucagcaugcguu

SEQ ID NO: 101 - RNA, 21 nt, Artificial Sequence
  source: /note="Description of Artificial Sequence: Synthetic oligonucleotide"
acuucuucuugggcaauaaau

SEQ ID NO: 102 - RNA, 21 nt, Artificial Sequence
  source: /note="Description of Artificial Sequence: Synthetic oligonucleotide"
uaauacaucagcaugcguuau

SEQ ID NO: 103 - RNA, 21 nt, Artificial Sequence
  source: /note="Description of Artificial Sequence: Synthetic oligonucleotide"
acgaagucguggaugccuugu

SEQ ID NO: 104 - RNA, 21 nt, Artificial Sequence
  source: /note="Description of Artificial Sequence: Synthetic oligonucleotide"
ccaaagacgaagucguggauu

SEQ ID NO: 105 - RNA, 21 nt, Artificial Sequence
  source: /note="Description of Artificial Sequence: Synthetic oligonucleotide"
agacaaagguggauacaugau

SEQ ID NO: 106 - RNA, 21 nt, Artificial Sequence
  source: /note="Description of Artificial Sequence: Synthetic oligonucleotide"
gacgaagucguggaugccuuu

SEQ ID NO: 107 - RNA, 21 nt, Artificial Sequence
  source: /note="Description of Artificial Sequence: Synthetic oligonucleotide"
cauccucagaagggauggauu

SEQ ID NO: 108 - RNA, 21 nt, Artificial Sequence
  source: /note="Description of Artificial Sequence: Synthetic oligonucleotide"
ugagucacuugaggaggcgau

SEQ ID NO: 109 - RNA, 23 nt, Artificial Sequence
  source: /note="Description of Artificial Sequence: Synthetic oligonucleotide"
aaguugcaaaucuugcucaugua

SEQ ID NO: 110 - RNA, 23 nt, Artificial Sequence
  source: /note="Description of Artificial Sequence: Synthetic oligonucleotide"
augaugguuguuuuggcaucaau

SEQ ID NO: 111 - RNA, 23 nt, Artificial Sequence
  source: /note="Description of Artificial Sequence: Synthetic oligonucleotide"
agcauccacgacuucgucuuugg

SEQ ID NO: 112 - RNA, 23 nt, Artificial Sequence
  source: /note="Description of Artificial Sequence: Synthetic oligonucleotide"
aaucuugcucauguauccaccuu

SEQ ID NO: 113 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaucgtcgggcauaucuggaag

SEQ ID NO: 114 - RNA, 23 nt, Artificial Sequence
  source: /note="Description of Artificial Sequence: Synthetic oligonucleotide"
aauccuaauggguagcaaguugc

SEQ ID NO: 115 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgacutcgucuuuggaccgaaa

SEQ ID NO: 116 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaucctaauggguagcaaguug

SEQ ID NO: 117 - RNA, 23 nt, Artificial Sequence
  source: /note="Description of Artificial Sequence: Synthetic oligonucleotide"
agucggaggaacuugcuuaaguu

SEQ ID NO: 118 - RNA, 23 nt, Artificial Sequence
  source: /note="Description of Artificial Sequence: Synthetic oligonucleotide"
acgaaggcauaucucucccagca

SEQ ID NO: 119 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguagctgcacaaagaugggaaa

SEQ ID NO: 120 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agucuutggaccgaaagucagac

SEQ ID NO: 121 - RNA, 23 nt, Artificial Sequence
  source: /note="Description of Artificial Sequence: Synthetic oligonucleotide"
auaguuaggugaaaaagguguuc

SEQ ID NO: 122 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagggtacguugucacucacuc

SEQ ID NO: 123 - RNA, 23 nt, Artificial Sequence
  source: /note="Description of Artificial Sequence: Synthetic oligonucleotide"
aagaggcguagacugagcuuggu

SEQ ID NO: 124 - RNA, 23 nt, Artificial Sequence
  source: /note="Description of Artificial Sequence: Synthetic oligonucleotide"
aucgaaggcauaucucucccagc

SEQ ID NO: 125 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaucctcgaaggcauaucucuc

SEQ ID NO: 126 - RNA, 23 nt, Artificial Sequence
  source: /note="Description of Artificial Sequence: Synthetic oligonucleotide"
aaucgcaauggcagauuccacag

SEQ ID NO: 127 - RNA, 23 nt, Artificial Sequence
  source: /note="Description of Artificial Sequence: Synthetic oligonucleotide"
agaaggguacguugucacucacu

SEQ ID NO: 128 - RNA, 23 nt, Artificial Sequence
  source: /note="Description of Artificial Sequence: Synthetic oligonucleotide"
auuauccuaauggguagcaaguu

SEQ ID NO: 129 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaucutgcucauguauccaccu

SEQ ID NO: 130 - RNA, 23 nt, Artificial Sequence
  source: /note="Description of Artificial Sequence: Synthetic oligonucleotide"
aagucucuggacaaucgcaaugg

SEQ ID NO: 131 - RNA, 23 nt, Artificial Sequence
  source: /note="Description of Artificial Sequence: Synthetic oligonucleotide"
acucuggacaaucgcaauggcag

SEQ ID NO: 132 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auacgutgucacucacuccucca

SEQ ID NO: 133 - RNA, 23 nt, Artificial Sequence
  source: /note="Description of Artificial Sequence: Synthetic oligonucleotide"
aaggguacguugucacucacucc

SEQ ID NO: 134 - RNA, 23 nt, Artificial Sequence
  source: /note="Description of Artificial Sequence: Synthetic oligonucleotide"
agguacguugucacucacuccuc

SEQ ID NO: 135 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcaggtacuuuauugcccaaga

SEQ ID NO: 136 - RNA, 23 nt, Artificial Sequence
  source: /note="Description of Artificial Sequence: Synthetic oligonucleotide"
aaaccagcugaauuaacgcaugc

SEQ ID NO: 137 - RNA, 23 nt, Artificial Sequence
  source: /note="Description of Artificial Sequence: Synthetic oligonucleotide"
agagaagguagagguucccugug

SEQ ID NO: 138 - RNA, 23 nt, Artificial Sequence
  source: /note="Description of Artificial Sequence: Synthetic oligonucleotide"
aucuggacaaucgcaauggcaga

SEQ ID NO: 139 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agucuctggacaaucgcaauggc

SEQ ID NO: 140 - RNA, 23 nt, Artificial Sequence
  source: /note="Description of Artificial Sequence: Synthetic oligonucleotide"
acauccacgacuucgucuuugga

SEQ ID NO: 141 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucgtcuuuggaccgaaaguc

SEQ ID NO: 142 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgactucgucuuuggaccgaa

SEQ ID NO: 143 - RNA, 23 nt, Artificial Sequence
  source: /note="Description of Artificial Sequence: Synthetic oligonucleotide"
aauccucgaaggcauaucucucc

SEQ ID NO: 144 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguacgtugucacucacuccucc

SEQ ID NO: 145 - RNA, 23 nt, Artificial Sequence
  source: /note="Description of Artificial Sequence: Synthetic oligonucleotide"
agacuugacuuuagggcagaugu

SEQ ID NO: 146 - RNA, 23 nt, Artificial Sequence
  source: /note="Description of Artificial Sequence: Synthetic oligonucleotide"
aggauaaggccacuguagaaggg

SEQ ID NO: 147 - RNA, 23 nt, Artificial Sequence
  source: /note="Description of Artificial Sequence: Synthetic oligonucleotide"
aaccagcugaauuaacgcaugcu

SEQ ID NO: 148 - RNA, 23 nt, Artificial Sequence
  source: /note="Description of Artificial Sequence: Synthetic oligonucleotide"
auccacgacuucgucuuuggacc

SEQ ID NO: 149 - RNA, 23 nt, Artificial Sequence
  source: /note="Description of Artificial Sequence: Synthetic oligonucleotide"
acugaccauuaauagggccacga

SEQ ID NO: 150 - RNA, 23 nt, Artificial Sequence
  source: /note="Description of Artificial Sequence: Synthetic oligonucleotide"
aaaggcauaucucucccagcacc

SEQ ID NO: 151 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agucautucccaaccagcugaau

SEQ ID NO: 152 - RNA, 23 nt, Artificial Sequence
  source: /note="Description of Artificial Sequence: Synthetic oligonucleotide"
aauuauccuaauggguagcaagu

SEQ ID NO: 153 - RNA, 23 nt, Artificial Sequence
  source: /note="Description of Artificial Sequence: Synthetic oligonucleotide"
aauauccucgaaggcauaucucu

SEQ ID NO: 154 - RNA, 23 nt, Artificial Sequence
  source: /note="Description of Artificial Sequence: Synthetic oligonucleotide"
agaaggcauaucucucccagcac

SEQ ID NO: 155 - RNA, 23 nt, Artificial Sequence
  source: /note="Description of Artificial Sequence: Synthetic oligonucleotide"
auggaacagucugaccauuaaua

SEQ ID NO: 156 - RNA, 23 nt, Artificial Sequence
  source: /note="Description of Artificial Sequence: Synthetic oligonucleotide"
acacgacuucgucuuuggaccga

SEQ ID NO: 157 - RNA, 23 nt, Artificial Sequence
  source: /note="Description of Artificial Sequence: Synthetic oligonucleotide"
aaauauccucgaaggcauaucuc

SEQ ID NO: 158 - RNA, 23 nt, Artificial Sequence
  source: /note="Description of Artificial Sequence: Synthetic oligonucleotide"
aggugucauuucccaaccagcug

SEQ ID NO: 159 - RNA, 23 nt, Artificial Sequence
  source: /note="Description of Artificial Sequence: Synthetic oligonucleotide"
agggauaaggccacuguagaagg

SEQ ID NO: 160 - RNA, 23 nt, Artificial Sequence
  source: /note="Description of Artificial Sequence: Synthetic oligonucleotide"
agaacagucugaccauuaauagg

SEQ ID NO: 161 - RNA, 23 nt, Artificial Sequence
  source: /note="Description of Artificial Sequence: Synthetic oligonucleotide"
agacuucgucuuuggaccgaaag

SEQ ID NO: 162 - RNA, 23 nt, Artificial Sequence
  source: /note="Description of Artificial Sequence: Synthetic oligonucleotide"
aaucgucgggcauaucuggaagc

SEQ ID NO: 163 - RNA, 23 nt, Artificial Sequence
  source: /note="Description of Artificial Sequence: Synthetic oligonucleotide"
aggugaaaaagguguucuaaaau

SEQ ID NO: 164 - RNA, 23 nt, Artificial Sequence
  source: /note="Description of Artificial Sequence: Synthetic oligonucleotide"
aaagguagagguucccugugcag

SEQ ID NO: 165 - RNA, 23 nt, Artificial Sequence
  source: /note="Description of Artificial Sequence: Synthetic oligonucleotide"
auccucgaaggcauaucucuccc

SEQ ID NO: 166 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggacutgacuuuagggcagaug

SEQ ID NO: 167 - RNA, 23 nt, Artificial Sequence
  source: /note="Description of Artificial Sequence: Synthetic oligonucleotide"
auccuaauggguagcaaguugca

SEQ ID NO: 168 - RNA, 23 nt, Artificial Sequence
  source: /note="Description of Artificial Sequence: Synthetic oligonucleotide"
aggguacguugucacucacuccu

SEQ ID NO: 169 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucguctuuggaccgaaagucag

SEQ ID NO: 170 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaaugtuccgacuccuggccuu

SEQ ID NO: 171 - RNA, 23 nt, Artificial Sequence
  source: /note="Description of Artificial Sequence: Synthetic oligonucleotide"
aacuucgucuuuggaccgaaagu

SEQ ID NO: 172 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacaatcgcaauggcagauucc

SEQ ID NO: 173 - RNA, 23 nt, Artificial Sequence
  source: /note="Description of Artificial Sequence: Synthetic oligonucleotide"
aagucaguaagggacccucugca

SEQ ID NO: 174 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuagctuuucauaaaaccaacu

SEQ ID NO: 175 - RNA, 23 nt, Artificial Sequence
  source: /note="Description of Artificial Sequence: Synthetic oligonucleotide"
aucugaccauuaauagggccacg

SEQ ID NO: 176 - RNA, 23 nt, Artificial Sequence
  source: /note="Description of Artificial Sequence: Synthetic oligonucleotide"
aaugaaggguacguugucacuca

SEQ ID NO: 177 - RNA, 23 nt, Artificial Sequence
  source: /note="Description of Artificial Sequence: Synthetic oligonucleotide"
aggaacagucugaccauuaauag

SEQ ID NO: 178 - RNA, 23 nt, Artificial Sequence
  source: /note="Description of Artificial Sequence: Synthetic oligonucleotide"
acaaugcggagguagcugcacaa

SEQ ID NO: 179 - RNA, 23 nt, Artificial Sequence
  source: /note="Description of Artificial Sequence: Synthetic oligonucleotide"
aacggugaugguuguuuuggcau

SEQ ID NO: 180 - RNA, 23 nt, Artificial Sequence
  source: /note="Description of Artificial Sequence: Synthetic oligonucleotide"
aaagucagacaccagaacguuuu

SEQ ID NO: 181 - RNA, 23 nt, Artificial Sequence
  source: /note="Description of Artificial Sequence: Synthetic oligonucleotide"
augucggaggaacuugcuuaagu

SEQ ID NO: 182 - RNA, 23 nt, Artificial Sequence
  source: /note="Description of Artificial Sequence: Synthetic oligonucleotide"
acaucaaugaaggguacguuguc

SEQ ID NO: 183 - RNA, 23 nt, Artificial Sequence
  source: /note="Description of Artificial Sequence: Synthetic oligonucleotide"
acaaugaaggguacguugucacu

SEQ ID NO: 184 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaguctgaccauuaauagggcc

SEQ ID NO: 185 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgucutuggaccgaaagucaga

SEQ ID NO: 186 - RNA, 23 nt, Artificial Sequence
  source: /note="Description of Artificial Sequence: Synthetic oligonucleotide"
acucauguauccaccuuugucuu

SEQ ID NO: 187 - RNA, 23 nt, Artificial Sequence
  source: /note="Description of Artificial Sequence: Synthetic oligonucleotide"
auucgucuuuggaccgaaaguca

SEQ ID NO: 188 - RNA, 23 nt, Artificial Sequence
  source: /note="Description of Artificial Sequence: Synthetic oligonucleotide"
aggucacuacacagcaaugcgga

SEQ ID NO: 189 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgcatgcugauguauuagagu

SEQ ID NO: 190 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuautgcccaagaagaaguuc

SEQ ID NO: 191 - RNA, 23 nt, Artificial Sequence
  source: /note="Description of Artificial Sequence: Synthetic oligonucleotide"
auaacgcaugcugauguauuaga

SEQ ID NO: 192 - RNA, 23 nt, Artificial Sequence
  source: /note="Description of Artificial Sequence: Synthetic oligonucleotide"
acaaggcauccacgacuucgucu

SEQ ID NO: 193 - RNA, 23 nt, Artificial Sequence
  source: /note="Description of Artificial Sequence: Synthetic oligonucleotide"
aauccacgacuucgucuuuggac

SEQ ID NO: 194 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucaugtauccaccuuugucuuu

SEQ ID NO: 195 - RNA, 23 nt, Artificial Sequence
  source: /note="Description of Artificial Sequence: Synthetic oligonucleotide"
aaaggcauccacgacuucgucuu

SEQ ID NO: 196 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauccatcccuucugaggaugac

SEQ ID NO: 197 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucgcctccucaagugacucaca

SEQ ID NO: 198 - RNA, 21 nt, Artificial Sequence
  source: /note="Description of Artificial Sequence: Synthetic oligonucleotide"
caugagcaagauuugcaacuu

SEQ ID NO: 199 - RNA, 21 nt, Artificial Sequence
  source: /note="Description of Artificial Sequence: Synthetic oligonucleotide"
ugaugccaaaacaaccaucau

SEQ ID NO: 200 - RNA, 21 nt, Artificial Sequence
  source: /note="Description of Artificial Sequence: Synthetic oligonucleotide"
aaagacgaagucguggaugcu

SEQ ID NO: 201 - RNA, 21 nt, Artificial Sequence
  source: /note="Description of Artificial Sequence: Synthetic oligonucleotide"
gguggauacaugagcaagauu

SEQ ID NO: 202 - RNA, 21 nt, Artificial Sequence
  source: /note="Description of Artificial Sequence: Synthetic oligonucleotide"
uccagauaugcccgacgaugu

SEQ ID NO: 203 - RNA, 21 nt, Artificial Sequence
  source: /note="Description of Artificial Sequence: Synthetic oligonucleotide"
aacuugcuacccauuaggauu

SEQ ID NO: 204 - RNA, 21 nt, Artificial Sequence
  source: /note="Description of Artificial Sequence: Synthetic oligonucleotide"
ucgguccaaagacgaagucgu

SEQ ID NO: 205 - RNA, 21 nt, Artificial Sequence
  source: /note="Description of Artificial Sequence: Synthetic oligonucleotide"
acuugcuacccauuaggauau

SEQ ID NO: 206 - RNA, 21 nt, Artificial Sequence
  source: /note="Description of Artificial Sequence: Synthetic oligonucleotide"
cuuaagcaaguuccuccgacu

SEQ ID NO: 207 - RNA, 21 nt, Artificial Sequence
  source: /note="Description of Artificial Sequence: Synthetic oligonucleotide"
cugggagagauaugccuucgu

SEQ ID NO: 208 - RNA, 21 nt, Artificial Sequence
  source: /note="Description of Artificial Sequence: Synthetic oligonucleotide"
ucccaucuuugugcagcuacu

SEQ ID NO: 209 - RNA, 21 nt, Artificial Sequence
  source: /note="Description of Artificial Sequence: Synthetic oligonucleotide"
cugacuuucgguccaaagacu

SEQ ID NO: 210 - RNA, 21 nt, Artificial Sequence
  source: /note="Description of Artificial Sequence: Synthetic oligonucleotide"
acaccuuuuucaccuaacuau

SEQ ID NO: 211 - RNA, 21 nt, Artificial Sequence
  source: /note="Description of Artificial Sequence: Synthetic oligonucleotide"
gugagugacaacguacccuuu

SEQ ID NO: 212 - RNA, 21 nt, Artificial Sequence
  source: /note="Description of Artificial Sequence: Synthetic oligonucleotide"
caagcucagucuacgccucuu

SEQ ID NO: 213 - RNA, 21 nt, Artificial Sequence
  source: /note="Description of Artificial Sequence: Synthetic oligonucleotide"
ugggagagauaugccuucgau

SEQ ID NO: 214 - RNA, 21 nt, Artificial Sequence
  source: /note="Description of Artificial Sequence: Synthetic oligonucleotide"
gagauaugccuucgaggauau

SEQ ID NO: 215 - RNA, 21 nt, Artificial Sequence
  source: /note="Description of Artificial Sequence: Synthetic oligonucleotide"
guggaaucugccauugcgauu

SEQ ID NO: 216 - RNA, 21 nt, Artificial Sequence
  source: /note="Description of Artificial Sequence: Synthetic oligonucleotide"
ugagugacaacguacccuucu

SEQ ID NO: 217 - RNA, 21 nt, Artificial Sequence
  source: /note="Description of Artificial Sequence: Synthetic oligonucleotide"
cuugcuacccauuaggauaau

SEQ ID NO: 218 - RNA, 21 nt, Artificial Sequence
  source: /note="Description of Artificial Sequence: Synthetic oligonucleotide"
guggauacaugagcaagauuu

SEQ ID NO: 219 - RNA, 21 nt, Artificial Sequence
  source: /note="Description of Artificial Sequence: Synthetic oligonucleotide"
auugcgauuguccagagacuu

SEQ ID NO: 220 - RNA, 21 nt, Artificial Sequence
  source: /note="Description of Artificial Sequence: Synthetic oligonucleotide"
gccauugcgauuguccagagu

SEQ ID NO: 221 - RNA, 21 nt, Artificial Sequence
  source: /note="Description of Artificial Sequence: Synthetic oligonucleotide"
gaggagugagugacaacguau

SEQ ID NO: 222 - RNA, 21 nt, Artificial Sequence
  source: /note="Description of Artificial Sequence: Synthetic oligonucleotide"
agugagugacaacguacccuu

SEQ ID NO: 223 - RNA, 21 nt, Artificial Sequence
  source: /note="Description of Artificial Sequence: Synthetic oligonucleotide"
ggagugagugacaacguaccu

SEQ ID NO: 224 - RNA, 21 nt, Artificial Sequence
  source: /note="Description of Artificial Sequence: Synthetic oligonucleotide"
uugggcaauaaaguaccugcu

SEQ ID NO: 225 - RNA, 21 nt, Artificial Sequence
  source: /note="Description of Artificial Sequence: Synthetic oligonucleotide"
augcguuaauucagcugguuu

SEQ ID NO: 226 - RNA, 21 nt, Artificial Sequence
  source: /note="Description of Artificial Sequence: Synthetic oligonucleotide"
cagggaaccucuaccuucucu

SEQ ID NO: 227 - RNA, 21 nt, Artificial Sequence
  source: /note="Description of Artificial Sequence: Synthetic oligonucleotide"
ugccauugcgauuguccagau

SEQ ID NO: 228 - RNA, 21 nt, Artificial Sequence
  source: /note="Description of Artificial Sequence: Synthetic oligonucleotide"
cauugcgauuguccagagacu

SEQ ID NO: 229 - RNA, 21 nt, Artificial Sequence
  source: /note="Description of Artificial Sequence: Synthetic oligonucleotide"
caaagacgaagucguggaugu

SEQ ID NO: 230 - RNA, 21 nt, Artificial Sequence
  source: /note="Description of Artificial Sequence: Synthetic oligonucleotide"
cuuucgguccaaagacgaagu

SEQ ID NO: 231 - RNA, 21 nt, Artificial Sequence
  source: /note="Description of Artificial Sequence: Synthetic oligonucleotide"
cgguccaaagacgaagucguu

SEQ ID NO: 232 - RNA, 21 nt, Artificial Sequence
  source: /note="Description of Artificial Sequence: Synthetic oligonucleotide"
agagauaugccuucgaggauu

SEQ ID NO: 233 - RNA, 21 nt, Artificial Sequence
  source: /note="Description of Artificial Sequence: Synthetic oligonucleotide"
aggagugagugacaacguacu

SEQ ID NO: 234 - RNA, 21 nt, Artificial Sequence
  source: /note="Description of Artificial Sequence: Synthetic oligonucleotide"
aucugcccuaaagucaagucu

SEQ ID NO: 235 - RNA, 21 nt, Artificial Sequence
  source: /note="Description of Artificial Sequence: Synthetic oligonucleotide"
cuucuacaguggccuuauccu

SEQ ID NO: 236 - RNA, 21 nt, Artificial Sequence
  source: /note="Description of Artificial Sequence: Synthetic oligonucleotide"
caugcguuaauucagcugguu

SEQ ID NO: 237 - RNA, 21 nt, Artificial Sequence
  source: /note="Description of Artificial Sequence: Synthetic oligonucleotide"
uccaaagacgaagucguggau

SEQ ID NO: 238 - RNA, 21 nt, Artificial Sequence
  source: /note="Description of Artificial Sequence: Synthetic oligonucleotide"
guggcccuauuaauggucagu

SEQ ID NO: 239 - RNA, 21 nt, Artificial Sequence
  source: /note="Description of Artificial Sequence: Synthetic oligonucleotide"
ugcugggagagauaugccuuu

SEQ ID NO: 240 - RNA, 21 nt, Artificial Sequence
  source: /note="Description of Artificial Sequence: Synthetic oligonucleotide"
ucagcugguugggaaaugacu

SEQ ID NO: 241 - RNA, 21 nt, Artificial Sequence
  source: /note="Description of Artificial Sequence: Synthetic oligonucleotide"
uugcuacccauuaggauaauu

SEQ ID NO: 242 - RNA, 21 nt, Artificial Sequence
  source: /note="Description of Artificial Sequence: Synthetic oligonucleotide"
agauaugccuucgaggauauu

SEQ ID NO: 243 - RNA, 21 nt, Artificial Sequence
  source: /note="Description of Artificial Sequence: Synthetic oligonucleotide"
gcugggagagauaugccuucu

SEQ ID NO: 244 - RNA, 21 nt, Artificial Sequence
  source: /note="Description of Artificial Sequence: Synthetic oligonucleotide"
uuaauggucagacuguuccau

SEQ ID NO: 245 - RNA, 21 nt, Artificial Sequence
  source: /note="Description of Artificial Sequence: Synthetic oligonucleotide"
gguccaaagacgaagucgugu

SEQ ID NO: 246 - RNA, 21 nt, Artificial Sequence
  source: /note="Description of Artificial Sequence: Synthetic oligonucleotide"
gauaugccuucgaggauauuu

SEQ ID NO: 247 - RNA, 21 nt, Artificial Sequence
  source: /note="Description of Artificial Sequence: Synthetic oligonucleotide"
gcugguugggaaaugacaccu

SEQ ID NO: 248 - RNA, 21 nt, Artificial Sequence
  source: /note="Description of Artificial Sequence: Synthetic oligonucleotide"
uucuacaguggccuuaucccu

SEQ ID NO: 249 - RNA, 21 nt, Artificial Sequence
  source: /note="Description of Artificial Sequence: Synthetic oligonucleotide"
uauuaauggucagacuguucu

SEQ ID NO: 250 - RNA, 21 nt, Artificial Sequence
  source: /note="Description of Artificial Sequence: Synthetic oligonucleotide"
uucgguccaaagacgaagucu

SEQ ID NO: 251 - RNA, 21 nt, Artificial Sequence
  source: /note="Description of Artificial Sequence: Synthetic oligonucleotide"
uuccagauaugcccgacgauu

SEQ ID NO: 252 - RNA, 21 nt, Artificial Sequence
  source: /note="Description of Artificial Sequence: Synthetic oligonucleotide"
uuuagaacaccuuuuucaccu

SEQ ID NO: 253 - RNA, 21 nt, Artificial Sequence
  source: /note="Description of Artificial Sequence: Synthetic oligonucleotide"
gcacagggaaccucuaccuuu

SEQ ID NO: 254 - RNA, 21 nt, Artificial Sequence
  source: /note="Description of Artificial Sequence: Synthetic oligonucleotide"
gagagauaugccuucgaggau

SEQ ID NO: 255 - RNA, 21 nt, Artificial Sequence
  source: /note="Description of Artificial Sequence: Synthetic oligonucleotide"
ucugcccuaaagucaaguccu

SEQ ID NO: 256 - RNA, 21 nt, Artificial Sequence
  source: /note="Description of Artificial Sequence: Synthetic oligonucleotide"
caacuugcuacccauuaggau

SEQ ID NO: 257 - RNA, 21 nt, Artificial Sequence
  source: /note="Description of Artificial Sequence: Synthetic oligonucleotide"
gagugagugacaacguacccu

SEQ ID NO: 258 - RNA, 21 nt, Artificial Sequence
  source: /note="Description of Artificial Sequence: Synthetic oligonucleotide"
gacuuucgguccaaagacgau

SEQ ID NO: 259 - RNA, 21 nt, Artificial Sequence
  source: /note="Description of Artificial Sequence: Synthetic oligonucleotide"
ggccaggagucggaacauugu

SEQ ID NO: 260 - RNA, 21 nt, Artificial Sequence
  source: /note="Description of Artificial Sequence: Synthetic oligonucleotide"
uuucgguccaaagacgaaguu

SEQ ID NO: 261 - RNA, 21 nt, Artificial Sequence
  source: /note="Description of Artificial Sequence: Synthetic oligonucleotide"
aaucugccauugcgauugucu

SEQ ID NO: 262 - RNA, 21 nt, Artificial Sequence
  source: /note="Description of Artificial Sequence: Synthetic oligonucleotide"
cagagggucccuuacugacuu

SEQ ID NO: 263 - RNA, 21 nt, Artificial Sequence
  source: /note="Description of Artificial Sequence: Synthetic oligonucleotide"
uugguuuuaugaaaagcuagu

SEQ ID NO: 264 - RNA, 21 nt, Artificial Sequence
  source: /note="Description of Artificial Sequence: Synthetic oligonucleotide"
uggcccuauuaauggucagau

SEQ ID NO: 265 - RNA, 21 nt, Artificial Sequence
  source: /note="Description of Artificial Sequence: Synthetic oligonucleotide"
agugacaacguacccuucauu

SEQ ID NO: 266 - RNA, 21 nt, Artificial Sequence
  source: /note="Description of Artificial Sequence: Synthetic oligonucleotide"
auuaauggucagacuguuccu

SEQ ID NO: 267 - RNA, 21 nt, Artificial Sequence
  source: /note="Description of Artificial Sequence: Synthetic oligonucleotide"
gugcagcuaccuccgcauugu

SEQ ID NO: 268 - RNA, 21 nt, Artificial Sequence
  source: /note="Description of Artificial Sequence: Synthetic oligonucleotide"
gccaaaacaaccaucaccguu

SEQ ID NO: 269 - RNA, 21 nt, Artificial Sequence
  source: /note="Description of Artificial Sequence: Synthetic oligonucleotide"
aacguucuggugucugacuuu

SEQ ID NO: 270 - RNA, 21 nt, Artificial Sequence
  source: /note="Description of Artificial Sequence: Synthetic oligonucleotide"
uuaagcaaguuccuccgacau

SEQ ID NO: 271 - RNA, 21 nt, Artificial Sequence
  source: /note="Description of Artificial Sequence: Synthetic oligonucleotide"
caacguacccuucauugaugu

SEQ ID NO: 272 - RNA, 21 nt, Artificial Sequence
  source: /note="Description of Artificial Sequence: Synthetic oligonucleotide"
ugacaacguacccuucauugu

SEQ ID NO: 273 - RNA, 21 nt, Artificial Sequence
  source: /note="Description of Artificial Sequence: Synthetic oligonucleotide"
cccuauuaauggucagacugu

SEQ ID NO: 274 - RNA, 21 nt, Artificial Sequence
  source: /note="Description of Artificial Sequence: Synthetic oligonucleotide"
ugacuuucgguccaaagacgu

SEQ ID NO: 275 - RNA, 21 nt, Artificial Sequence
  source: /note="Description of Artificial Sequence: Synthetic oligonucleotide"
gacaaagguggauacaugagu

SEQ ID NO: 276 - RNA, 21 nt, Artificial Sequence
  source: /note="Description of Artificial Sequence: Synthetic oligonucleotide"
acuuucgguccaaagacgaau

SEQ ID NO: 277 - RNA, 21 nt, Artificial Sequence
  source: /note="Description of Artificial Sequence: Synthetic oligonucleotide"
cgcauugcuguguagugaccu

SEQ ID NO: 278 - RNA, 21 nt, Artificial Sequence
  source: /note="Description of Artificial Sequence: Synthetic oligonucleotide"
ucuaauacaucagcaugcguu

SEQ ID NO: 279 - RNA, 21 nt, Artificial Sequence
  source: /note="Description of Artificial Sequence: Synthetic oligonucleotide"
acuucuucuugggcaauaaau

SEQ ID NO: 280 - RNA, 21 nt, Artificial Sequence
  source: /note="Description of Artificial Sequence: Synthetic oligonucleotide"
uaauacaucagcaugcguuau

SEQ ID NO: 281 - RNA, 21 nt, Artificial Sequence
  source: /note="Description of Artificial Sequence: Synthetic oligonucleotide"
acgaagucguggaugccuugu

SEQ ID NO: 282 - RNA, 21 nt, Artificial Sequence
  source: /note="Description of Artificial Sequence: Synthetic oligonucleotide"
ccaaagacgaagucguggauu

SEQ ID NO: 283 - RNA, 21 nt, Artificial Sequence
  source: /note="Description of Artificial Sequence: Synthetic oligonucleotide"
agacaaagguggauacaugau

SEQ ID NO: 284 - RNA, 21 nt, Artificial Sequence
  source: /note="Description of Artificial Sequence: Synthetic oligonucleotide"
gacgaagucguggaugccuuu

SEQ ID NO: 285 - RNA, 21 nt, Artificial Sequence
  source: /note="Description of Artificial Sequence: Synthetic oligonucleotide"
cauccucagaagggauggauu

SEQ ID NO: 286 - RNA, 21 nt, Artificial Sequence
  source: /note="Description of Artificial Sequence: Synthetic oligonucleotide"
ugagucacuugaggaggcgau

SEQ ID NO: 287 - RNA, 23 nt, Artificial Sequence
  source: /note="Description of Artificial Sequence: Synthetic oligonucleotide"
aaguugcaaaucuugcucaugua

SEQ ID NO: 288 - RNA, 23 nt, Artificial Sequence
  source: /note="Description of Artificial Sequence: Synthetic oligonucleotide"
augaugguuguuuuggcaucaau

SEQ ID NO: 289 - RNA, 23 nt, Artificial Sequence
  source: /note="Description of Artificial Sequence: Synthetic oligonucleotide"
agcauccacgacuucgucuuugg

SEQ ID NO: 290 - RNA, 23 nt, Artificial Sequence
  source: /note="Description of Artificial Sequence: Synthetic oligonucleotide"
aaucuugcucauguauccaccuu

SEQ ID NO: 291 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaucgtcgggcauaucuggaag

SEQ ID NO: 292 - RNA, 23 nt, Artificial Sequence
  source: /note="Description of Artificial Sequence: Synthetic oligonucleotide"
aauccuaauggguagcaaguugc

SEQ ID NO: 293 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgacutcgucuuuggaccgaaa

SEQ ID NO: 294 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaucctaauggguagcaaguug

SEQ ID NO: 295 - RNA, 23 nt, Artificial Sequence
  source: /note="Description of Artificial Sequence: Synthetic oligonucleotide"
agucggaggaacuugcuuaaguu

SEQ ID NO: 296 - RNA, 23 nt, Artificial Sequence
  source: /note="Description of Artificial Sequence: Synthetic oligonucleotide"
acgaaggcauaucucucccagca

SEQ ID NO: 297 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguagctgcacaaagaugggaaa

SEQ ID NO: 298 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agucuutggaccgaaagucagac

SEQ ID NO: 299 - RNA, 23 nt, Artificial Sequence
  source: /note="Description of Artificial Sequence: Synthetic oligonucleotide"
auaguuaggugaaaaagguguuc

SEQ ID NO: 300 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagggtacguugucacucacuc

SEQ ID NO: 301 - RNA, 23 nt, Artificial Sequence
  source: /note="Description of Artificial Sequence: Synthetic oligonucleotide"
aagaggcguagacugagcuuggu

SEQ ID NO: 302 - RNA, 23 nt, Artificial Sequence
  source: /note="Description of Artificial Sequence: Synthetic oligonucleotide"
aucgaaggcauaucucucccagc

SEQ ID NO: 303 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaucctcgaaggcauaucucuc

SEQ ID NO: 304 - RNA, 23 nt, Artificial Sequence
  source: /note="Description of Artificial Sequence: Synthetic oligonucleotide"
aaucgcaauggcagauuccacag

SEQ ID NO: 305 - RNA, 23 nt, Artificial Sequence
  source: /note="Description of Artificial Sequence: Synthetic oligonucleotide"
agaaggguacguugucacucacu

SEQ ID NO: 306 - RNA, 23 nt, Artificial Sequence
  source: /note="Description of Artificial Sequence: Synthetic oligonucleotide"
auuauccuaauggguagcaaguu

SEQ ID NO: 307 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaucutgcucauguauccaccu

SEQ ID NO: 308 - RNA, 23 nt, Artificial Sequence
  source: /note="Description of Artificial Sequence: Synthetic oligonucleotide"
aagucucuggacaaucgcaaugg

SEQ ID NO: 309 - RNA, 23 nt, Artificial Sequence
  source: /note="Description of Artificial Sequence: Synthetic oligonucleotide"
acucuggacaaucgcaauggcag

SEQ ID NO: 310 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auacgutgucacucacuccucca

SEQ ID NO: 311 - RNA, 23 nt, Artificial Sequence
  source: /note="Description of Artificial Sequence: Synthetic oligonucleotide"
aaggguacguugucacucacucc

SEQ ID NO: 312 - RNA, 23 nt, Artificial Sequence
  source: /note="Description of Artificial Sequence: Synthetic oligonucleotide"
agguacguugucacucacuccuc

SEQ ID NO: 313 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcaggtacuuuauugcccaaga

SEQ ID NO: 314 - RNA, 23 nt, Artificial Sequence
  source: /note="Description of Artificial Sequence: Synthetic oligonucleotide"
aaaccagcugaauuaacgcaugc

SEQ ID NO: 315 - RNA, 23 nt, Artificial Sequence
  source: /note="Description of Artificial Sequence: Synthetic oligonucleotide"
agagaagguagagguucccugug

SEQ ID NO: 316 - RNA, 23 nt, Artificial Sequence
  source: /note="Description of Artificial Sequence: Synthetic oligonucleotide"
aucuggacaaucgcaauggcaga

SEQ ID NO: 317 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agucuctggacaaucgcaauggc

SEQ ID NO: 318 - RNA, 23 nt, Artificial Sequence
  source: /note="Description of Artificial Sequence: Synthetic oligonucleotide"
acauccacgacuucgucuuugga

SEQ ID NO: 319 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucgtcuuuggaccgaaaguc

SEQ ID NO: 320 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgactucgucuuuggaccgaa

SEQ ID NO: 321 - RNA, 23 nt, Artificial Sequence
  source: /note="Description of Artificial Sequence: Synthetic oligonucleotide"
aauccucgaaggcauaucucucc

SEQ ID NO: 322 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguacgtugucacucacuccucc

SEQ ID NO: 323 - RNA, 23 nt, Artificial Sequence
  source: /note="Description of Artificial Sequence: Synthetic oligonucleotide"
agacuugacuuuagggcagaugu

SEQ ID NO: 324 - RNA, 23 nt, Artificial Sequence
  source: /note="Description of Artificial Sequence: Synthetic oligonucleotide"
aggauaaggccacuguagaaggg

SEQ ID NO: 325 - RNA, 23 nt, Artificial Sequence
  source: /note="Description of Artificial Sequence: Synthetic oligonucleotide"
aaccagcugaauuaacgcaugcu

SEQ ID NO: 326 - RNA, 23 nt, Artificial Sequence
  source: /note="Description of Artificial Sequence: Synthetic oligonucleotide"
auccacgacuucgucuuuggacc

SEQ ID NO: 327 - RNA, 23 nt, Artificial Sequence
  source: /note="Description of Artificial Sequence: Synthetic oligonucleotide"
acugaccauuaauagggccacga

SEQ ID NO: 328 - RNA, 23 nt, Artificial Sequence
  source: /note="Description of Artificial Sequence: Synthetic oligonucleotide"
aaaggcauaucucucccagcacc

SEQ ID NO: 329 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agucautucccaaccagcugaau

SEQ ID NO: 330 - RNA, 23 nt, Artificial Sequence
  source: /note="Description of Artificial Sequence: Synthetic oligonucleotide"
aauuauccuaauggguagcaagu

SEQ ID NO: 331 - RNA, 23 nt, Artificial Sequence
  source: /note="Description of Artificial Sequence: Synthetic oligonucleotide"
aauauccucgaaggcauaucucu

SEQ ID NO: 332 - RNA, 23 nt, Artificial Sequence
  source: /note="Description of Artificial Sequence: Synthetic oligonucleotide"
agaaggcauaucucucccagcac

SEQ ID NO: 333 - RNA, 23 nt, Artificial Sequence
  source: /note="Description of Artificial Sequence: Synthetic oligonucleotide"
auggaacagucugaccauuaaua

SEQ ID NO: 334 - RNA, 23 nt, Artificial Sequence
  source: /note="Description of Artificial Sequence: Synthetic oligonucleotide"
acacgacuucgucuuuggaccga

SEQ ID NO: 335 - RNA, 23 nt, Artificial Sequence
  source: /note="Description of Artificial Sequence: Synthetic oligonucleotide"
aaauauccucgaaggcauaucuc

SEQ ID NO: 336 - RNA, 23 nt, Artificial Sequence
  source: /note="Description of Artificial Sequence: Synthetic oligonucleotide"
aggugucauuucccaaccagcug

SEQ ID NO: 337 - RNA, 23 nt, Artificial Sequence
  source: /note="Description of Artificial Sequence: Synthetic oligonucleotide"
agggauaaggccacuguagaagg

SEQ ID NO: 338 - RNA, 23 nt, Artificial Sequence
  source: /note="Description of Artificial Sequence: Synthetic oligonucleotide"
agaacagucugaccauuaauagg

SEQ ID NO: 339 - RNA, 23 nt, Artificial Sequence
  source: /note="Description of Artificial Sequence: Synthetic oligonucleotide"
agacuucgucuuuggaccgaaag

SEQ ID NO: 340 - RNA, 23 nt, Artificial Sequence
  source: /note="Description of Artificial Sequence: Synthetic oligonucleotide"
aaucgucgggcauaucuggaagc

SEQ ID NO: 341 - RNA, 23 nt, Artificial Sequence
  source: /note="Description of Artificial Sequence: Synthetic oligonucleotide"
aggugaaaaagguguucuaaaau

SEQ ID NO: 342 - RNA, 23 nt, Artificial Sequence
  source: /note="Description of Artificial Sequence: Synthetic oligonucleotide"
aaagguagagguucccugugcag

SEQ ID NO: 343 - RNA, 23 nt, Artificial Sequence
  source: /note="Description of Artificial Sequence: Synthetic oligonucleotide"
auccucgaaggcauaucucuccc

SEQ ID NO: 344 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggacutgacuuuagggcagaug

SEQ ID NO: 345 - RNA, 23 nt, Artificial Sequence
  source: /note="Description of Artificial Sequence: Synthetic oligonucleotide"
auccuaauggguagcaaguugca

SEQ ID NO: 346 - RNA, 23 nt, Artificial Sequence
  source: /note="Description of Artificial Sequence: Synthetic oligonucleotide"
aggguacguugucacucacuccu

SEQ ID NO: 347 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucguctuuggaccgaaagucag

SEQ ID NO: 348 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaaugtuccgacuccuggccuu

SEQ ID NO: 349 - RNA, 23 nt, Artificial Sequence
  source: /note="Description of Artificial Sequence: Synthetic oligonucleotide"
aacuucgucuuuggaccgaaagu

SEQ ID NO: 350 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacaatcgcaauggcagauucc

SEQ ID NO: 351 - RNA, 23 nt, Artificial Sequence
  source: /note="Description of Artificial Sequence: Synthetic oligonucleotide"
aagucaguaagggacccucugca

SEQ ID NO: 352 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuagctuuucauaaaaccaacu

SEQ ID NO: 353 - RNA, 23 nt, Artificial Sequence
  source: /note="Description of Artificial Sequence: Synthetic oligonucleotide"
aucugaccauuaauagggccacg

SEQ ID NO: 354 - RNA, 23 nt, Artificial Sequence
  source: /note="Description of Artificial Sequence: Synthetic oligonucleotide"
aaugaaggguacguugucacuca

SEQ ID NO: 355 - RNA, 23 nt, Artificial Sequence
  source: /note="Description of Artificial Sequence: Synthetic oligonucleotide"
aggaacagucugaccauuaauag

SEQ ID NO: 356 - RNA, 23 nt, Artificial Sequence
  source: /note="Description of Artificial Sequence: Synthetic oligonucleotide"
acaaugcggagguagcugcacaa

SEQ ID NO: 357 - RNA, 23 nt, Artificial Sequence
  source: /note="Description of Artificial Sequence: Synthetic oligonucleotide"
aacggugaugguuguuuuggcau

SEQ ID NO: 358 - RNA, 23 nt, Artificial Sequence
  source: /note="Description of Artificial Sequence: Synthetic oligonucleotide"
aaagucagacaccagaacguuuu

SEQ ID NO: 359 - RNA, 23 nt, Artificial Sequence
  source: /note="Description of Artificial Sequence: Synthetic oligonucleotide"
augucggaggaacuugcuuaagu

SEQ ID NO: 360 - RNA, 23 nt, Artificial Sequence
  source: /note="Description of Artificial Sequence: Synthetic oligonucleotide"
acaucaaugaaggguacguuguc

SEQ ID NO: 361 - RNA, 23 nt, Artificial Sequence
  source: /note="Description of Artificial Sequence: Synthetic oligonucleotide"
acaaugaaggguacguugucacu

SEQ ID NO: 362 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaguctgaccauuaauagggcc

SEQ ID NO: 363 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgucutuggaccgaaagucaga

SEQ ID NO: 364 - RNA, 23 nt, Artificial Sequence
  source: /note="Description of Artificial Sequence: Synthetic oligonucleotide"
acucauguauccaccuuugucuu

SEQ ID NO: 365 - RNA, 23 nt, Artificial Sequence
  source: /note="Description of Artificial Sequence: Synthetic oligonucleotide"
auucgucuuuggaccgaaaguca

SEQ ID NO: 366 - RNA, 23 nt, Artificial Sequence
  source: /note="Description of Artificial Sequence: Synthetic oligonucleotide"
aggucacuacacagcaaugcgga

SEQ ID NO: 367 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgcatgcugauguauuagagu

SEQ ID NO: 368 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuautgcccaagaagaaguuc

SEQ ID NO: 369 - RNA, 23 nt, Artificial Sequence
  source: /note="Description of Artificial Sequence: Synthetic oligonucleotide"
auaacgcaugcugauguauuaga

SEQ ID NO: 370 - RNA, 23 nt, Artificial Sequence
  source: /note="Description of Artificial Sequence: Synthetic oligonucleotide"
acaaggcauccacgacuucgucu

SEQ ID NO: 371 - RNA, 23 nt, Artificial Sequence
  source: /note="Description of Artificial Sequence: Synthetic oligonucleotide"
aauccacgacuucgucuuuggac

SEQ ID NO: 372 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucaugtauccaccuuugucuuu

SEQ ID NO: 373 - RNA, 23 nt, Artificial Sequence
  source: /note="Description of Artificial Sequence: Synthetic oligonucleotide"
aaaggcauccacgacuucgucuu

SEQ ID NO: 374 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauccatcccuucugaggaugac

SEQ ID NO: 375 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucgcctccucaagugacucaca

SEQ ID NO: 376 - RNA, 23 nt, Artificial Sequence
  source: /note="Description of Artificial Sequence: Synthetic oligonucleotide"
uacaugagcaagauuugcaacuu

SEQ ID NO: 377 - RNA, 23 nt, Artificial Sequence
  source: /note="Description of Artificial Sequence: Synthetic oligonucleotide"
auugaugccaaaacaaccaucac

SEQ ID NO: 378 - RNA, 23 nt, Artificial Sequence
  source: /note="Description of Artificial Sequence: Synthetic oligonucleotide"
ccaaagacgaagucguggaugcc

SEQ ID NO: 379 - RNA, 23 nt, Artificial Sequence
  source: /note="Description of Artificial Sequence: Synthetic oligonucleotide"
aagguggauacaugagcaagauu

SEQ ID NO: 380 - RNA, 23 nt, Artificial Sequence
  source: /note="Description of Artificial Sequence: Synthetic oligonucleotide"
cuuccagauaugcccgacgaugu

SEQ ID NO: 381 - RNA, 23 nt, Artificial Sequence
  source: /note="Description of Artificial Sequence: Synthetic oligonucleotide"
gcaacuugcuacccauuaggaua

SEQ ID NO: 382 - RNA, 23 nt, Artificial Sequence
  source: /note="Description of Artificial Sequence: Synthetic oligonucleotide"
uuucgguccaaagacgaagucgu

SEQ ID NO: 383 - RNA, 23 nt, Artificial Sequence
  source: /note="Description of Artificial Sequence: Synthetic oligonucleotide"
caacuugcuacccauuaggauaa

SEQ ID NO: 384 - RNA, 23 nt, Artificial Sequence
  source: /note="Description of Artificial Sequence: Synthetic oligonucleotide"
aacuuaagcaaguuccuccgaca

SEQ ID NO: 385 - RNA, 23 nt, Artificial Sequence
  source: /note="Description of Artificial Sequence: Synthetic oligonucleotide"
ugcugggagagauaugccuucga

SEQ ID NO: 386 - RNA, 23 nt, Artificial Sequence
  source: /note="Description of Artificial Sequence: Synthetic oligonucleotide"
uuucccaucuuugugcagcuacc

SEQ ID NO: 387 - RNA, 23 nt, Artificial Sequence
  source: /note="Description of Artificial Sequence: Synthetic oligonucleotide"
gucugacuuucgguccaaagacg

SEQ ID NO: 388 - RNA, 23 nt, Artificial Sequence
  source: /note="Description of Artificial Sequence: Synthetic oligonucleotide"
gaacaccuuuuucaccuaacuaa

SEQ ID NO: 389 - RNA, 23 nt, Artificial Sequence
  source: /note="Description of Artificial Sequence: Synthetic oligonucleotide"
gagugagugacaacguacccuuc

SEQ ID NO: 390 - RNA, 23 nt, Artificial Sequence
  source: /note="Description of Artificial Sequence: Synthetic oligonucleotide"
accaagcucagucuacgccucug

SEQ ID NO: 391 - RNA, 23 nt, Artificial Sequence
  source: /note="Description of Artificial Sequence: Synthetic oligonucleotide"
gcugggagagauaugccuucgag

SEQ ID NO: 392 - RNA, 23 nt, Artificial Sequence
  source: /note="Description of Artificial Sequence: Synthetic oligonucleotide"
gagagauaugccuucgaggauau

SEQ ID NO: 393 - RNA, 23 nt, Artificial Sequence
  source: /note="Description of Artificial Sequence: Synthetic oligonucleotide"
cuguggaaucugccauugcgauu

SEQ ID NO: 394 - RNA, 23 nt, Artificial Sequence
  source: /note="Description of Artificial Sequence: Synthetic oligonucleotide"
agugagugacaacguacccuuca

SEQ ID NO: 395 - RNA, 23 nt, Artificial Sequence
  source: /note="Description of Artificial Sequence: Synthetic oligonucleotide"
aacuugcuacccauuaggauaau

SEQ ID NO: 396 - RNA, 23 nt, Artificial Sequence
  source: /note="Description of Artificial Sequence: Synthetic oligonucleotide"
agguggauacaugagcaagauuu

SEQ ID NO: 397 - RNA, 23 nt, Artificial Sequence
  source: /note="Description of Artificial Sequence: Synthetic oligonucleotide"
ccauugcgauuguccagagacug

SEQ ID NO: 398 - RNA, 23 nt, Artificial Sequence
  source: /note="Description of Artificial Sequence: Synthetic oligonucleotide"
cugccauugcgauuguccagaga

SEQ ID NO: 399 - RNA, 23 nt, Artificial Sequence
  source: /note="Description of Artificial Sequence: Synthetic oligonucleotide"
uggaggagugagugacaacguac

SEQ ID NO: 400 - RNA, 23 nt, Artificial Sequence
  source: /note="Description of Artificial Sequence: Synthetic oligonucleotide"
ggagugagugacaacguacccuu

SEQ ID NO: 401 - RNA, 23 nt, Artificial Sequence
  source: /note="Description of Artificial Sequence: Synthetic oligonucleotide"
gaggagugagugacaacguaccc

SEQ ID NO: 402 - RNA, 23 nt, Artificial Sequence
  source: /note="Description of Artificial Sequence: Synthetic oligonucleotide"
ucuugggcaauaaaguaccugcu

SEQ ID NO: 403 - RNA, 23 nt, Artificial Sequence
  source: /note="Description of Artificial Sequence: Synthetic oligonucleotide"
gcaugcguuaauucagcugguug

SEQ ID NO: 404 - RNA, 23 nt, Artificial Sequence
  source: /note="Description of Artificial Sequence: Synthetic oligonucleotide"
cacagggaaccucuaccuucucu

SEQ ID NO: 405 - RNA, 23 nt, Artificial Sequence
  source: /note="Description of Artificial Sequence: Synthetic oligonucleotide"
ucugccauugcgauuguccagag

SEQ ID NO: 406 - RNA, 23 nt, Artificial Sequence
  source: /note="Description of Artificial Sequence: Synthetic oligonucleotide"
gccauugcgauuguccagagacu

SEQ ID NO: 407 - RNA, 23 nt, Artificial Sequence
  source: /note="Description of Artificial Sequence: Synthetic oligonucleotide"
uccaaagacgaagucguggaugc

SEQ ID NO: 408 - RNA, 23 nt, Artificial Sequence
  source: /note="Description of Artificial Sequence: Synthetic oligonucleotide"
gacuuucgguccaaagacgaagu

SEQ ID NO: 409 - RNA, 23 nt, Artificial Sequence
  source: /note="Description of Artificial Sequence: Synthetic oligonucleotide"
uucgguccaaagacgaagucgug

SEQ ID NO: 410 - RNA, 23 nt, Artificial Sequence
  source: /note="Description of Artificial Sequence: Synthetic oligonucleotide"
ggagagauaugccuucgaggaua

SEQ ID NO: 411 - RNA, 23 nt, Artificial Sequence
  source: /note="Description of Artificial Sequence: Synthetic oligonucleotide"
ggaggagugagugacaacguacc

SEQ ID NO: 412 - RNA, 23 nt, Artificial Sequence
  source: /note="Description of Artificial Sequence: Synthetic oligonucleotide"
acaucugcccuaaagucaagucc

SEQ ID NO: 413 - RNA, 23 nt, Artificial Sequence
  source: /note="Description of Artificial Sequence: Synthetic oligonucleotide"
cccuucuacaguggccuuauccc

SEQ ID NO: 414 - RNA, 23 nt, Artificial Sequence
  source: /note="Description of Artificial Sequence: Synthetic oligonucleotide"
agcaugcguuaauucagcugguu

SEQ ID NO: 415 - RNA, 23 nt, Artificial Sequence
  source: /note="Description of Artificial Sequence: Synthetic oligonucleotide"
gguccaaagacgaagucguggau

SEQ ID NO: 416 - RNA, 23 nt, Artificial Sequence
  source: /note="Description of Artificial Sequence: Synthetic oligonucleotide"
ucguggcccuauuaauggucaga

SEQ ID NO: 417 - RNA, 23 nt, Artificial Sequence
  source: /note="Description of Artificial Sequence: Synthetic oligonucleotide"
ggugcugggagagauaugccuuc

SEQ ID NO: 418 - RNA, 23 nt, Artificial Sequence
  source: /note="Description of Artificial Sequence: Synthetic oligonucleotide"
auucagcugguugggaaaugaca

SEQ ID NO: 419 - RNA, 23 nt, Artificial Sequence
  source: /note="Description of Artificial Sequence: Synthetic oligonucleotide"
acuugcuacccauuaggauaaug

SEQ ID NO: 420 - RNA, 23 nt, Artificial Sequence
  source: /note="Description of Artificial Sequence: Synthetic oligonucleotide"
agagauaugccuucgaggauauu

SEQ ID NO: 421 - RNA, 23 nt, Artificial Sequence
  source: /note="Description of Artificial Sequence: Synthetic oligonucleotide"
gugcugggagagauaugccuucg

SEQ ID NO: 422 - RNA, 23 nt, Artificial Sequence
  source: /note="Description of Artificial Sequence: Synthetic oligonucleotide"
uauuaauggucagacuguuccag

SEQ ID NO: 423 - RNA, 23 nt, Artificial Sequence
  source: /note="Description of Artificial Sequence: Synthetic oligonucleotide"
ucgguccaaagacgaagucgugg

SEQ ID NO: 424 - RNA, 23 nt, Artificial Sequence
  source: /note="Description of Artificial Sequence: Synthetic oligonucleotide"
gagauaugccuucgaggauauuu

SEQ ID NO: 425 - RNA, 23 nt, Artificial Sequence
  source: /note="Description of Artificial Sequence: Synthetic oligonucleotide"
cagcugguugggaaaugacacca

SEQ ID NO: 426 - RNA, 23 nt, Artificial Sequence
  source: /note="Description of Artificial Sequence: Synthetic oligonucleotide"
ccuucuacaguggccuuaucccu

SEQ ID NO: 427 - RNA, 23 nt, Artificial Sequence
  source: /note="Description of Artificial Sequence: Synthetic oligonucleotide"
ccuauuaauggucagacuguucc

SEQ ID NO: 428 - RNA, 23 nt, Artificial Sequence
  source: /note="Description of Artificial Sequence: Synthetic oligonucleotide"
cuuucgguccaaagacgaagucg

SEQ ID NO: 429 - RNA, 23 nt, Artificial Sequence
  source: /note="Description of Artificial Sequence: Synthetic oligonucleotide"
gcuuccagauaugcccgacgaug

SEQ ID NO: 430 - RNA, 23 nt, Artificial Sequence
  source: /note="Description of Artificial Sequence: Synthetic oligonucleotide"
auuuuagaacaccuuuuucaccu

SEQ ID NO: 431 - RNA, 23 nt, Artificial Sequence
  source: /note="Description of Artificial Sequence: Synthetic oligonucleotide"
cugcacagggaaccucuaccuuc

SEQ ID NO: 432 - RNA, 23 nt, Artificial Sequence
  source: /note="Description of Artificial Sequence: Synthetic oligonucleotide"
gggagagauaugccuucgaggau

SEQ ID NO: 433 - RNA, 23 nt, Artificial Sequence
  source: /note="Description of Artificial Sequence: Synthetic oligonucleotide"
caucugcccuaaagucaagucca

SEQ ID NO: 434 - RNA, 23 nt, Artificial Sequence
  source: /note="Description of Artificial Sequence: Synthetic oligonucleotide"
ugcaacuugcuacccauuaggau

SEQ ID NO: 435 - RNA, 23 nt, Artificial Sequence
  source: /note="Description of Artificial Sequence: Synthetic oligonucleotide"
aggagugagugacaacguacccu

SEQ ID NO: 436 - RNA, 23 nt, Artificial Sequence
  source: /note="Description of Artificial Sequence: Synthetic oligonucleotide"
cugacuuucgguccaaagacgaa

SEQ ID NO: 437 - RNA, 23 nt, Artificial Sequence
  source: /note="Description of Artificial Sequence: Synthetic oligonucleotide"
aaggccaggagucggaacauugg

SEQ ID NO: 438 - RNA, 23 nt, Artificial Sequence
  source: /note="Description of Artificial Sequence: Synthetic oligonucleotide"
acuuucgguccaaagacgaaguc

SEQ ID NO: 439 - RNA, 23 nt, Artificial Sequence
  source: /note="Description of Artificial Sequence: Synthetic oligonucleotide"
ggaaucugccauugcgauugucc

SEQ ID NO: 440 - RNA, 23 nt, Artificial Sequence
  source: /note="Description of Artificial Sequence: Synthetic oligonucleotide"
ugcagagggucccuuacugacug

SEQ ID NO: 441 - RNA, 23 nt, Artificial Sequence
  source: /note="Description of Artificial Sequence: Synthetic oligonucleotide"
aguugguuuuaugaaaagcuagg

SEQ ID NO: 442 - RNA, 23 nt, Artificial Sequence
  source: /note="Description of Artificial Sequence: Synthetic oligonucleotide"
cguggcccuauuaauggucagac

SEQ ID NO: 443 - RNA, 23 nt, Artificial Sequence
  source: /note="Description of Artificial Sequence: Synthetic oligonucleotide"
ugagugacaacguacccuucauu

SEQ ID NO: 444 - RNA, 23 nt, Artificial Sequence
  source: /note="Description of Artificial Sequence: Synthetic oligonucleotide"
cuauuaauggucagacuguucca

SEQ ID NO: 445 - RNA, 23 nt, Artificial Sequence
  source: /note="Description of Artificial Sequence: Synthetic oligonucleotide"
uugugcagcuaccuccgcauugc

SEQ ID NO: 446 - RNA, 23 nt, Artificial Sequence
  source: /note="Description of Artificial Sequence: Synthetic oligonucleotide"
augccaaaacaaccaucaccgug

SEQ ID NO: 447 - RNA, 23 nt, Artificial Sequence
  source: /note="Description of Artificial Sequence: Synthetic oligonucleotide"
aaaacguucuggugucugacuuu

SEQ ID NO: 448 - RNA, 23 nt, Artificial Sequence
  source: /note="Description of Artificial Sequence: Synthetic oligonucleotide"
acuuaagcaaguuccuccgacag

SEQ ID NO: 449 - RNA, 23 nt, Artificial Sequence
  source: /note="Description of Artificial Sequence: Synthetic oligonucleotide"
gacaacguacccuucauugaugc

SEQ ID NO: 450 - RNA, 23 nt, Artificial Sequence
  source: /note="Description of Artificial Sequence: Synthetic oligonucleotide"
agugacaacguacccuucauuga

SEQ ID NO: 451 - RNA, 23 nt, Artificial Sequence
  source: /note="Description of Artificial Sequence: Synthetic oligonucleotide"
ggcccuauuaauggucagacugu

SEQ ID NO: 452 - RNA, 23 nt, Artificial Sequence
  source: /note="Description of Artificial Sequence: Synthetic oligonucleotide"
ucugacuuucgguccaaagacga

SEQ ID NO: 453 - RNA, 23 nt, Artificial Sequence
  source: /note="Description of Artificial Sequence: Synthetic oligonucleotide"
aagacaaagguggauacaugagc

SEQ ID NO: 454 - RNA, 23 nt, Artificial Sequence
  source: /note="Description of Artificial Sequence: Synthetic oligonucleotide"
ugacuuucgguccaaagacgaag

SEQ ID NO: 455 - RNA, 23 nt, Artificial Sequence
  source: /note="Description of Artificial Sequence: Synthetic oligonucleotide"
uccgcauugcuguguagugaccc

SEQ ID NO: 456 - RNA, 23 nt, Artificial Sequence
  source: /note="Description of Artificial Sequence: Synthetic oligonucleotide"
acucuaauacaucagcaugcguu

SEQ ID NO: 457 - RNA, 23 nt, Artificial Sequence
  source: /note="Description of Artificial Sequence: Synthetic oligonucleotide"
gaacuucuucuugggcaauaaag

SEQ ID NO: 458 - RNA, 23 nt, Artificial Sequence
  source: /note="Description of Artificial Sequence: Synthetic oligonucleotide"
ucuaauacaucagcaugcguuaa

SEQ ID NO: 459 - RNA, 23 nt, Artificial Sequence
  source: /note="Description of Artificial Sequence: Synthetic oligonucleotide"
agacgaagucguggaugccuugg

SEQ ID NO: 460 - RNA, 23 nt, Artificial Sequence
  source: /note="Description of Artificial Sequence: Synthetic oligonucleotide"
guccaaagacgaagucguggaug

SEQ ID NO: 461 - RNA, 23 nt, Artificial Sequence
  source: /note="Description of Artificial Sequence: Synthetic oligonucleotide"
aaagacaaagguggauacaugag

SEQ ID NO: 462 - RNA, 23 nt, Artificial Sequence
  source: /note="Description of Artificial Sequence: Synthetic oligonucleotide"
aagacgaagucguggaugccuug

SEQ ID NO: 463 - RNA, 23 nt, Artificial Sequence
  source: /note="Description of Artificial Sequence: Synthetic oligonucleotide"
gucauccucagaagggauggauc

SEQ ID NO: 464 - RNA, 23 nt, Artificial Sequence
  source: /note="Description of Artificial Sequence: Synthetic oligonucleotide"
ugugagucacuugaggaggcgag

SEQ ID NO: 465 - RNA, 21 nt, Artificial Sequence
  source: /note="Description of Artificial Sequence: Synthetic oligonucleotide"
accuguugaauuuuguauuau

SEQ ID NO: 466 - RNA, 21 nt, Artificial Sequence
  source: /note="Description of Artificial Sequence: Synthetic oligonucleotide"
uaccuguugaauuuuguauuu

SEQ ID NO: 467 - RNA, 21 nt, Artificial Sequence
  source: /note="Description of Artificial Sequence: Synthetic oligonucleotide"
guuguuaccuguugaauuuuu

SEQ ID NO: 468 - RNA, 21 nt, Artificial Sequence
  source: /note="Description of Artificial Sequence: Synthetic oligonucleotide"
uuaccuguugaauuuuguauu

SEQ ID NO: 469 - RNA, 21 nt, Artificial Sequence
  source: /note="Description of Artificial Sequence: Synthetic oligonucleotide"
uugaaccuggcuuauuuucuu

SEQ ID NO: 470 - RNA, 21 nt, Artificial Sequence
  source: /note="Description of Artificial Sequence: Synthetic oligonucleotide"
cuuuuucaccuaacuaaaauu

SEQ ID NO: 471 - RNA, 21 nt, Artificial Sequence
  source: /note="Description of Artificial Sequence: Synthetic oligonucleotide"
uguuaccuguugaauuuuguu

SEQ ID NO: 472 - RNA, 21 nt, Artificial Sequence
  source: /note="Description of Artificial Sequence: Synthetic oligonucleotide"
cuugaaccuggcuuauuuucu

SEQ ID NO: 473 - RNA, 21 nt, Artificial Sequence
  source: /note="Description of Artificial Sequence: Synthetic oligonucleotide"
aggauaaugucuuauguaauu

SEQ ID NO: 474 - RNA, 21 nt, Artificial Sequence
  source: /note="Description of Artificial Sequence: Synthetic oligonucleotide"
uuuuucaccuaacuaaaauau

SEQ ID NO: 475 - RNA, 21 nt, Artificial Sequence
  source: /note="Description of Artificial Sequence: Synthetic oligonucleotide"
caccuaacuaaaauaauguuu

SEQ ID NO: 476 - RNA, 21 nt, Artificial Sequence
  source: /note="Description of Artificial Sequence: Synthetic oligonucleotide"
caucagcaugcguuaauucau

SEQ ID NO: 477 - RNA, 21 nt, Artificial Sequence
  source: /note="Description of Artificial Sequence: Synthetic oligonucleotide"
gguaacaagaugauaaucuau

SEQ ID NO: 478 - RNA, 21 nt, Artificial Sequence
  source: /note="Description of Artificial Sequence: Synthetic oligonucleotide"
uuucaccuaacuaaaauaauu

SEQ ID NO: 479 - RNA, 21 nt, Artificial Sequence
  source: /note="Description of Artificial Sequence: Synthetic oligonucleotide"
uucaccuaacuaaaauaaugu

SEQ ID NO: 480 - RNA, 21 nt, Artificial Sequence
  source: /note="Description of Artificial Sequence: Synthetic oligonucleotide"
gugagauguuaguagaauaau

SEQ ID NO: 481 - RNA, 21 nt, Artificial Sequence
  source: /note="Description of Artificial Sequence: Synthetic oligonucleotide"
gauaaccuugacuacuaaaau

SEQ ID NO: 482 - RNA, 21 nt, Artificial Sequence
  source: /note="Description of Artificial Sequence: Synthetic oligonucleotide"
accuuuuucaccuaacuaaau

SEQ ID NO: 483 - RNA, 21 nt, Artificial Sequence
  source: /note="Description of Artificial Sequence: Synthetic oligonucleotide"
gagcugaguugguuuuaugau

SEQ ID NO: 484 - RNA, 21 nt, Artificial Sequence
  source: /note="Description of Artificial Sequence: Synthetic oligonucleotide"
cguuguuaccuguugaauuuu

SEQ ID NO: 485 - RNA, 21 nt, Artificial Sequence
  source: /note="Description of Artificial Sequence: Synthetic oligonucleotide"
ugagauugcaccauuucauuu

SEQ ID NO: 486 - RNA, 21 nt, Artificial Sequence
  source: /note="Description of Artificial Sequence: Synthetic oligonucleotide"
agcugaguugguuuuaugaau

SEQ ID NO: 487 - RNA, 21 nt, Artificial Sequence
  source: /note="Description of Artificial Sequence: Synthetic oligonucleotide"
ccuuuuucaccuaacuaaaau

SEQ ID NO: 488 - RNA, 21 nt, Artificial Sequence
  source: /note="Description of Artificial Sequence: Synthetic oligonucleotide"
uuuucaccuaacuaaaauaau

SEQ ID NO: 489 - RNA, 21 nt, Artificial Sequence
  source: /note="Description of Artificial Sequence: Synthetic oligonucleotide"
ucaccuaacuaaaauaauguu

SEQ ID NO: 490 - RNA, 21 nt, Artificial Sequence
  source: /note="Description of Artificial Sequence: Synthetic oligonucleotide"
acuugaaccuggcuuauuuuu

SEQ ID NO: 491 - RNA, 21 nt, Artificial Sequence
  source: /note="Description of Artificial Sequence: Synthetic oligonucleotide"
ucuucuugggcaauaaaguau

SEQ ID NO: 492 - RNA, 21 nt, Artificial Sequence
  source: /note="Description of Artificial Sequence: Synthetic oligonucleotide"
uucuucuugggcaauaaaguu

SEQ ID NO: 493 - RNA, 23 nt, Artificial Sequence
  source: /note="Description of Artificial Sequence: Synthetic oligonucleotide"
auaauacaaaauucaacagguaa

SEQ ID NO: 494 - RNA, 23 nt, Artificial Sequence
  source: /note="Description of Artificial Sequence: Synthetic oligonucleotide"
aaauacaaaauucaacagguaac

SEQ ID NO: 495 - RNA, 23 nt, Artificial Sequence
  source: /note="Description of Artificial Sequence: Synthetic oligonucleotide"
aaaaauucaacagguaacaacgc

SEQ ID NO: 496 - RNA, 23 nt, Artificial Sequence
  source: /note="Description of Artificial Sequence: Synthetic oligonucleotide"
aauacaaaauucaacagguaaca

SEQ ID NO: 497 - RNA, 23 nt, Artificial Sequence
  source: /note="Description of Artificial Sequence: Synthetic oligonucleotide"
aagaaaauaagccagguucaagu

SEQ ID NO: 498 - RNA, 23 nt, Artificial Sequence
  source: /note="Description of Artificial Sequence: Synthetic oligonucleotide"
aauuuuaguuaggugaaaaaggu

SEQ ID NO: 499 - RNA, 23 nt, Artificial Sequence
  source: /note="Description of Artificial Sequence: Synthetic oligonucleotide"
aacaaaauucaacagguaacaac

SEQ ID NO: 500 - RNA, 23 nt, Artificial Sequence
  source: /note="Description of Artificial Sequence: Synthetic oligonucleotide"
agaaaauaagccagguucaaguu

SEQ ID NO: 501 - RNA, 23 nt, Artificial Sequence
  source: /note="Description of Artificial Sequence: Synthetic oligonucleotide"
aauuacauaagacauuauccuaa

SEQ ID NO: 502 - RNA, 23 nt, Artificial Sequence
  source: /note="Description of Artificial Sequence: Synthetic oligonucleotide"
auauuuuaguuaggugaaaaagg

SEQ ID NO: 503 - RNA, 23 nt, Artificial Sequence
  source: /note="Description of Artificial Sequence: Synthetic oligonucleotide"
aaacauuauuuuaguuaggugaa

SEQ ID NO: 504 - RNA, 23 nt, Artificial Sequence
  source: /note="Description of Artificial Sequence: Synthetic oligonucleotide"
augaauuaacgcaugcugaugua

SEQ ID NO: 505 - RNA, 23 nt, Artificial Sequence
  source: /note="Description of Artificial Sequence: Synthetic oligonucleotide"
auagauuaucaucuuguuacccc

SEQ ID NO: 506 - RNA, 23 nt, Artificial Sequence
  source: /note="Description of Artificial Sequence: Synthetic oligonucleotide"
aauuauuuuaguuaggugaaaaa

SEQ ID NO: 507 - RNA, 23 nt, Artificial Sequence
  source: /note="Description of Artificial Sequence: Synthetic oligonucleotide"
acauuauuuuaguuaggugaaaa

SEQ ID NO: 508 - RNA, 23 nt, Artificial Sequence
  source: /note="Description of Artificial Sequence: Synthetic oligonucleotide"
auuauucuacuaacaucucacug

SEQ ID NO: 509 - RNA, 23 nt, Artificial Sequence
  source: /note="Description of Artificial Sequence: Synthetic oligonucleotide"
auuuuaguagucaagguuaucau

SEQ ID NO: 510 - RNA, 23 nt, Artificial Sequence
  source: /note="Description of Artificial Sequence: Synthetic oligonucleotide"
auuuaguuaggugaaaaaggugu

SEQ ID NO: 511 - RNA, 23 nt, Artificial Sequence
  source: /note="Description of Artificial Sequence: Synthetic oligonucleotide"
aucauaaaaccaacucagcucag

SEQ ID NO: 512 - RNA, 23 nt, Artificial Sequence
  source: /note="Description of Artificial Sequence: Synthetic oligonucleotide"
aaaauucaacagguaacaacgcu

SEQ ID NO: 513 - RNA, 23 nt, Artificial Sequence
  source: /note="Description of Artificial Sequence: Synthetic oligonucleotide"
aaaugaaauggugcaaucucagc

SEQ ID NO: 514 - RNA, 23 nt, Artificial Sequence
  source: /note="Description of Artificial Sequence: Synthetic oligonucleotide"
auucauaaaaccaacucagcuca

SEQ ID NO: 515 - RNA, 23 nt, Artificial Sequence
  source: /note="Description of Artificial Sequence: Synthetic oligonucleotide"
auuuuaguuaggugaaaaaggug

SEQ ID NO: 516 - RNA, 23 nt, Artificial Sequence
  source: /note="Description of Artificial Sequence: Synthetic oligonucleotide"
auuauuuuaguuaggugaaaaag

SEQ ID NO: 517 - RNA, 23 nt, Artificial Sequence
  source: /note="Description of Artificial Sequence: Synthetic oligonucleotide"
aacauuauuuuaguuaggugaaa

SEQ ID NO: 518 - RNA, 23 nt, Artificial Sequence
  source: /note="Description of Artificial Sequence: Synthetic oligonucleotide"
aaaaauaagccagguucaaguug

SEQ ID NO: 519 - RNA, 23 nt, Artificial Sequence
  source: /note="Description of Artificial Sequence: Synthetic oligonucleotide"
auacuuuauugcccaagaagaag

SEQ ID NO: 520 - RNA, 23 nt, Artificial Sequence
  source: /note="Description of Artificial Sequence: Synthetic oligonucleotide"
aacuuuauugcccaagaagaagu

SEQ ID NO: 521 - RNA, 21 nt, Artificial Sequence
  source: /note="Description of Artificial Sequence: Synthetic oligonucleotide"
accuguugaauuuuguauuau

SEQ ID NO: 522 - RNA, 21 nt, Artificial Sequence
  source: /note="Description of Artificial Sequence: Synthetic oligonucleotide"
uaccuguugaauuuuguauuu

SEQ ID NO: 523 - RNA, 21 nt, Artificial Sequence
  source: /note="Description of Artificial Sequence: Synthetic oligonucleotide"
guuguuaccuguugaauuuuu

SEQ ID NO: 524 - RNA, 21 nt, Artificial Sequence
  source: /note="Description of Artificial Sequence: Synthetic oligonucleotide"
uuaccuguugaauuuuguauu

SEQ ID NO: 525 - RNA, 21 nt, Artificial Sequence
  source: /note="Description of Artificial Sequence: Synthetic oligonucleotide"
uugaaccuggcuuauuuucuu

SEQ ID NO: 526 - RNA, 21 nt, Artificial Sequence
  source: /note="Description of Artificial Sequence: Synthetic oligonucleotide"
cuuuuucaccuaacuaaaauu

SEQ ID NO: 527 - RNA, 21 nt, Artificial Sequence
  source: /note="Description of Artificial Sequence: Synthetic oligonucleotide"
uguuaccuguugaauuuuguu

SEQ ID NO: 528 - RNA, 21 nt, Artificial Sequence
  source: /note="Description of Artificial Sequence: Synthetic oligonucleotide"
cuugaaccuggcuuauuuucu

SEQ ID NO: 529 - RNA, 21 nt, Artificial Sequence
  source: /note="Description of Artificial Sequence: Synthetic oligonucleotide"
aggauaaugucuuauguaauu

SEQ ID NO: 530 - RNA, 21 nt, Artificial Sequence
  source: /note="Description of Artificial Sequence: Synthetic oligonucleotide"
uuuuucaccuaacuaaaauau

SEQ ID NO: 531 - RNA, 21 nt, Artificial Sequence
  source: /note="Description of Artificial Sequence: Synthetic oligonucleotide"
caccuaacuaaaauaauguuu

SEQ ID NO: 532 - RNA, 21 nt, Artificial Sequence
  source: /note="Description of Artificial Sequence: Synthetic oligonucleotide"
caucagcaugcguuaauucau

SEQ ID NO: 533 - RNA, 21 nt, Artificial Sequence
  source: /note="Description of Artificial Sequence: Synthetic oligonucleotide"
gguaacaagaugauaaucuau

SEQ ID NO: 534 - RNA, 21 nt, Artificial Sequence
  source: /note="Description of Artificial Sequence: Synthetic oligonucleotide"
uuucaccuaacuaaaauaauu

SEQ ID NO: 535 - RNA, 21 nt, Artificial Sequence
  source: /note="Description of Artificial Sequence: Synthetic oligonucleotide"
uucaccuaacuaaaauaaugu

SEQ ID NO: 536 - RNA, 21 nt, Artificial Sequence
  source: /note="Description of Artificial Sequence: Synthetic oligonucleotide"
gugagauguuaguagaauaau

SEQ ID NO: 537 - RNA, 21 nt, Artificial Sequence
  source: /note="Description of Artificial Sequence: Synthetic oligonucleotide"
gauaaccuugacuacuaaaau

SEQ ID NO: 538 - RNA, 21 nt, Artificial Sequence
  source: /note="Description of Artificial Sequence: Synthetic oligonucleotide"
accuuuuucaccuaacuaaau

SEQ ID NO: 539 - RNA, 21 nt, Artificial Sequence
  source: /note="Description of Artificial Sequence: Synthetic oligonucleotide"
gagcugaguugguuuuaugau

SEQ ID NO: 540 - RNA, 21 nt, Artificial Sequence
  source: /note="Description of Artificial Sequence: Synthetic oligonucleotide"
cguuguuaccuguugaauuuu

SEQ ID NO: 541 - RNA, 21 nt, Artificial Sequence
  source: /note="Description of Artificial Sequence: Synthetic oligonucleotide"
ugagauugcaccauuucauuu

SEQ ID NO: 542 - RNA, 21 nt, Artificial Sequence
  source: /note="Description of Artificial Sequence: Synthetic oligonucleotide"
agcugaguugguuuuaugaau

SEQ ID NO: 543 - RNA, 21 nt, Artificial Sequence
  source: /note="Description of Artificial Sequence: Synthetic oligonucleotide"
ccuuuuucaccuaacuaaaau

SEQ ID NO: 544 - RNA, 21 nt, Artificial Sequence
  source: /note="Description of Artificial Sequence: Synthetic oligonucleotide"
uuuucaccuaacuaaaauaau

SEQ ID NO: 545 - RNA, 21 nt, Artificial Sequence
  source: /note="Description of Artificial Sequence: Synthetic oligonucleotide"
ucaccuaacuaaaauaauguu

SEQ ID NO: 546 - RNA, 21 nt, Artificial Sequence
  source: /note="Description of Artificial Sequence: Synthetic oligonucleotide"
acuugaaccuggcuuauuuuu

SEQ ID NO: 547 - RNA, 21 nt, Artificial Sequence
  source: /note="Description of Artificial Sequence: Synthetic oligonucleotide"
ucuucuugggcaauaaaguau

SEQ ID NO: 548 - RNA, 21 nt, Artificial Sequence
  source: /note="Description of Artificial Sequence: Synthetic oligonucleotide"
uucuucuugggcaauaaaguu

SEQ ID NO: 549 - RNA, 23 nt, Artificial Sequence
  source: /note="Description of Artificial Sequence: Synthetic oligonucleotide"
auaauacaaaauucaacagguaa

SEQ ID NO: 550 - RNA, 23 nt, Artificial Sequence
  source: /note="Description of Artificial Sequence: Synthetic oligonucleotide"
aaauacaaaauucaacagguaac

SEQ ID NO: 551 - RNA, 23 nt, Artificial Sequence
  source: /note="Description of Artificial Sequence: Synthetic oligonucleotide"
aaaaauucaacagguaacaacgc

SEQ ID NO: 552 - RNA, 23 nt, Artificial Sequence
  source: /note="Description of Artificial Sequence: Synthetic oligonucleotide"
aauacaaaauucaacagguaaca

SEQ ID NO: 553 - RNA, 23 nt, Artificial Sequence
  source: /note="Description of Artificial Sequence: Synthetic oligonucleotide"
aagaaaauaagccagguucaagu

SEQ ID NO: 554 - RNA, 23 nt, Artificial Sequence
  source: /note="Description of Artificial Sequence: Synthetic oligonucleotide"
aauuuuaguuaggugaaaaaggu

SEQ ID NO: 555 - RNA, 23 nt, Artificial Sequence
  source: /note="Description of Artificial Sequence: Synthetic oligonucleotide"
aacaaaauucaacagguaacaac

SEQ ID NO: 556 - RNA, 23 nt, Artificial Sequence
  source: /note="Description of Artificial Sequence: Synthetic oligonucleotide"
agaaaauaagccagguucaaguu

SEQ ID NO: 557 - RNA, 23 nt, Artificial Sequence
  source: /note="Description of Artificial Sequence: Synthetic oligonucleotide"
aauuacauaagacauuauccuaa

SEQ ID NO: 558 - RNA, 23 nt, Artificial Sequence
  source: /note="Description of Artificial Sequence: Synthetic oligonucleotide"
auauuuuaguuaggugaaaaagg

SEQ ID NO: 559 - RNA, 23 nt, Artificial Sequence
  source: /note="Description of Artificial Sequence: Synthetic oligonucleotide"
aaacauuauuuuaguuaggugaa

SEQ ID NO: 560 - RNA, 23 nt, Artificial Sequence
  source: /note="Description of Artificial Sequence: Synthetic oligonucleotide"
augaauuaacgcaugcugaugua

SEQ ID NO: 561 - RNA, 23 nt, Artificial Sequence
  source: /note="Description of Artificial Sequence: Synthetic oligonucleotide"
auagauuaucaucuuguuacccc

SEQ ID NO: 562 - RNA, 23 nt, Artificial Sequence
  source: /note="Description of Artificial Sequence: Synthetic oligonucleotide"
aauuauuuuaguuaggugaaaaa

SEQ ID NO: 563 - RNA, 23 nt, Artificial Sequence
  source: /note="Description of Artificial Sequence: Synthetic oligonucleotide"
acauuauuuuaguuaggugaaaa

SEQ ID NO: 564 - RNA, 23 nt, Artificial Sequence
  source: /note="Description of Artificial Sequence: Synthetic oligonucleotide"
auuauucuacuaacaucucacug

SEQ ID NO: 565 - RNA, 23 nt, Artificial Sequence
  source: /note="Description of Artificial Sequence: Synthetic oligonucleotide"
auuuuaguagucaagguuaucau

SEQ ID NO: 566 - RNA, 23 nt, Artificial Sequence
  source: /note="Description of Artificial Sequence: Synthetic oligonucleotide"
auuuaguuaggugaaaaaggugu

SEQ ID NO: 567 - RNA, 23 nt, Artificial Sequence
  source: /note="Description of Artificial Sequence: Synthetic oligonucleotide"
aucauaaaaccaacucagcucag

SEQ ID NO: 568 - RNA, 23 nt, Artificial Sequence
  source: /note="Description of Artificial Sequence: Synthetic oligonucleotide"
aaaauucaacagguaacaacgcu

SEQ ID NO: 569 - RNA, 23 nt, Artificial Sequence
  source: /note="Description of Artificial Sequence: Synthetic oligonucleotide"
aaaugaaauggugcaaucucagc

SEQ ID NO: 570 - RNA, 23 nt, Artificial Sequence
  source: /note="Description of Artificial Sequence: Synthetic oligonucleotide"
auucauaaaaccaacucagcuca

SEQ ID NO: 571 - RNA, 23 nt, Artificial Sequence
  source: /note="Description of Artificial Sequence: Synthetic oligonucleotide"
auuuuaguuaggugaaaaaggug

SEQ ID NO: 572 - RNA, 23 nt, Artificial Sequence
  source: /note="Description of Artificial Sequence: Synthetic oligonucleotide"
auuauuuuaguuaggugaaaaag

SEQ ID NO: 573 - RNA, 23 nt, Artificial Sequence
  source: /note="Description of Artificial Sequence: Synthetic oligonucleotide"
aacauuauuuuaguuaggugaaa

SEQ ID NO: 574 - RNA, 23 nt, Artificial Sequence
  source: /note="Description of Artificial Sequence: Synthetic oligonucleotide"
aaaaauaagccagguucaaguug

SEQ ID NO: 575 - RNA, 23 nt, Artificial Sequence
  source: /note="Description of Artificial Sequence: Synthetic oligonucleotide"
auacuuuauugcccaagaagaag

SEQ ID NO: 576 - RNA, 23 nt, Artificial Sequence
  source: /note="Description of Artificial Sequence: Synthetic oligonucleotide"
aacuuuauugcccaagaagaagu

SEQ ID NO: 577 - RNA, 23 nt, Artificial Sequence
  source: /note="Description of Artificial Sequence: Synthetic oligonucleotide"
uuaccuguugaauuuuguauuau

SEQ ID NO: 578 - RNA, 23 nt, Artificial Sequence
  source: /note="Description of Artificial Sequence: Synthetic oligonucleotide"
guuaccuguugaauuuuguauua

SEQ ID NO: 579 - RNA, 23 nt, Artificial Sequence
  source: /note="Description of Artificial Sequence: Synthetic oligonucleotide"
gcguuguuaccuguugaauuuug

SEQ ID NO: 580 - RNA, 23 nt, Artificial Sequence
  source: /note="Description of Artificial Sequence: Synthetic oligonucleotide"
uguuaccuguugaauuuuguauu

SEQ ID NO: 581 - RNA, 23 nt, Artificial Sequence
  source: /note="Description of Artificial Sequence: Synthetic oligonucleotide"
acuugaaccuggcuuauuuucug

SEQ ID NO: 582 - RNA, 23 nt, Artificial Sequence
  source: /note="Description of Artificial Sequence: Synthetic oligonucleotide"
accuuuuucaccuaacuaaaaua

SEQ ID NO: 583 - RNA, 23 nt, Artificial Sequence
  source: /note="Description of Artificial Sequence: Synthetic oligonucleotide"
guuguuaccuguugaauuuugua

SEQ ID NO: 584 - RNA, 23 nt, Artificial Sequence
  source: /note="Description of Artificial Sequence: Synthetic oligonucleotide"
aacuugaaccuggcuuauuuucu

SEQ ID NO: 585 - RNA, 23 nt, Artificial Sequence
  source: /note="Description of Artificial Sequence: Synthetic oligonucleotide"
uuaggauaaugucuuauguaaug

SEQ ID NO: 586 - RNA, 23 nt, Artificial Sequence
  source: /note="Description of Artificial Sequence: Synthetic oligonucleotide"
ccuuuuucaccuaacuaaaauaa

SEQ ID NO: 587 - RNA, 23 nt, Artificial Sequence
  source: /note="Description of Artificial Sequence: Synthetic oligonucleotide"
uucaccuaacuaaaauaauguuu

SEQ ID NO: 588 - RNA, 23 nt, Artificial Sequence
  source: /note="Description of Artificial Sequence: Synthetic oligonucleotide"
uacaucagcaugcguuaauucag

SEQ ID NO: 589 - RNA, 23 nt, Artificial Sequence
  source: /note="Description of Artificial Sequence: Synthetic oligonucleotide"
gggguaacaagaugauaaucuac

SEQ ID NO: 590 - RNA, 23 nt, Artificial Sequence
  source: /note="Description of Artificial Sequence: Synthetic oligonucleotide"
uuuuucaccuaacuaaaauaaug

SEQ ID NO: 591 - RNA, 23 nt, Artificial Sequence
  source: /note="Description of Artificial Sequence: Synthetic oligonucleotide"
uuuucaccuaacuaaaauaaugu

SEQ ID NO: 592 - RNA, 23 nt, Artificial Sequence
  source: /note="Description of Artificial Sequence: Synthetic oligonucleotide"
cagugagauguuaguagaauaag

SEQ ID NO: 593 - RNA, 23 nt, Artificial Sequence
  source: /note="Description of Artificial Sequence: Synthetic oligonucleotide"
augauaaccuugacuacuaaaaa

SEQ ID NO: 594 - RNA, 23 nt, Artificial Sequence
  source: /note="Description of Artificial Sequence: Synthetic oligonucleotide"
acaccuuuuucaccuaacuaaaa

SEQ ID NO: 595 - RNA, 23 nt, Artificial Sequence
  source: /note="Description of Artificial Sequence: Synthetic oligonucleotide"
cugagcugaguugguuuuaugaa

SEQ ID NO: 596 - RNA, 23 nt, Artificial Sequence
  source: /note="Description of Artificial Sequence: Synthetic oligonucleotide"
agcguuguuaccuguugaauuuu

SEQ ID NO: 597 - RNA, 23 nt, Artificial Sequence
  source: /note="Description of Artificial Sequence: Synthetic oligonucleotide"
gcugagauugcaccauuucauuc

SEQ ID NO: 598 - RNA, 23 nt, Artificial Sequence
  source: /note="Description of Artificial Sequence: Synthetic oligonucleotide"
ugagcugaguugguuuuaugaaa

SEQ ID NO: 599 - RNA, 23 nt, Artificial Sequence
  source: /note="Description of Artificial Sequence: Synthetic oligonucleotide"
caccuuuuucaccuaacuaaaau

SEQ ID NO: 600 - RNA, 23 nt, Artificial Sequence
  source: /note="Description of Artificial Sequence: Synthetic oligonucleotide"
cuuuuucaccuaacuaaaauaau

SEQ ID NO: 601 - RNA, 23 nt, Artificial Sequence
  source: /note="Description of Artificial Sequence: Synthetic oligonucleotide"
uuucaccuaacuaaaauaauguu

SEQ ID NO: 602 - RNA, 23 nt, Artificial Sequence
  source: /note="Description of Artificial Sequence: Synthetic oligonucleotide"
caacuugaaccuggcuuauuuuc

SEQ ID NO: 603 - RNA, 23 nt, Artificial Sequence
  source: /note="Description of Artificial Sequence: Synthetic oligonucleotide"
cuucuucuugggcaauaaaguac

SEQ ID NO: 604 - RNA, 23 nt, Artificial Sequence
  source: /note="Description of Artificial Sequence: Synthetic oligonucleotide"
acuucuucuugggcaauaaagua

SEQ ID NO: 605 - RNA, 19 nt, Artificial Sequence
  source: /note="Description of Artificial Sequence: Synthetic oligonucleotide"
ggauaaugucuuauguaau

SEQ ID NO: 606 - RNA, 19 nt, Artificial Sequence
  source: /note="Description of Artificial Sequence: Synthetic oligonucleotide"
gagugagugacaacguacu

SEQ ID NO: 607 - RNA, 19 nt, Artificial Sequence
  source: /note="Description of Artificial Sequence: Synthetic oligonucleotide"
ggagagauaugccuucgau

SEQ ID NO: 608 - RNA, 19 nt, Artificial Sequence
  source: /note="Description of Artificial Sequence: Synthetic oligonucleotide"
uggugacauggcuuccagu

SEQ ID NO: 609 - RNA, 19 nt, Artificial Sequence
  source: /note="Description of Artificial Sequence: Synthetic oligonucleotide"
gaagucguggaugccuugu

SEQ ID NO: 610 - RNA, 19 nt, Artificial Sequence
  source: /note="Description of Artificial Sequence: Synthetic oligonucleotide"
ggagugagugacaacguau

SEQ ID NO: 611 - RNA, 19 nt, Artificial Sequence
  source: /note="Description of Artificial Sequence: Synthetic oligonucleotide"
gauaaugucuuauguaauu

SEQ ID NO: 612 - RNA, 19 nt, Artificial Sequence
  source: /note="Description of Artificial Sequence: Synthetic oligonucleotide"
gguuuuaugaaaagcuagu

SEQ ID NO: 613 - RNA, 19 nt, Artificial Sequence
  source: /note="Description of Artificial Sequence: Synthetic oligonucleotide"
caaaacaaccaucaccguu

SEQ ID NO: 614 - RNA, 19 nt, Artificial Sequence
  source: /note="Description of Artificial Sequence: Synthetic oligonucleotide"
gauaugccuucgaggauau

SEQ ID NO: 615 - RNA, 19 nt, Artificial Sequence
  source: /note="Description of Artificial Sequence: Synthetic oligonucleotide"
ccauugcgauuguccagau

SEQ ID NO: 616 - RNA, 19 nt, Artificial Sequence
  source: /note="Description of Artificial Sequence: Synthetic oligonucleotide"
acagggaaccucuaccuuu

SEQ ID NO: 617 - RNA, 19 nt, Artificial Sequence
  source: /note="Description of Artificial Sequence: Synthetic oligonucleotide"
ugcuacccauuaggauaau

SEQ ID NO: 618 - RNA, 19 nt, Artificial Sequence
  source: /note="Description of Artificial Sequence: Synthetic oligonucleotide"
ccuguugaauuuuguauuu

SEQ ID NO: 619 - RNA, 19 nt, Artificial Sequence
  source: /note="Description of Artificial Sequence: Synthetic oligonucleotide"
agugagugacaacguaccu

SEQ ID NO: 620 - RNA, 19 nt, Artificial Sequence
  source: /note="Description of Artificial Sequence: Synthetic oligonucleotide"
cgaagucguggaugccuuu

SEQ ID NO: 621 - RNA, 19 nt, Artificial Sequence
  source: /note="Description of Artificial Sequence: Synthetic oligonucleotide"
cuuuuucaccuaacuaaau

SEQ ID NO: 622 - RNA, 19 nt, Artificial Sequence
  source: /note="Description of Artificial Sequence: Synthetic oligonucleotide"
gcuacccauuaggauaauu

SEQ ID NO: 623 - RNA, 19 nt, Artificial Sequence
  source: /note="Description of Artificial Sequence: Synthetic oligonucleotide"
gaaccuggcuuauuuucuu

SEQ ID NO: 624 - RNA, 19 nt, Artificial Sequence
  source: /note="Description of Artificial Sequence: Synthetic oligonucleotide"
ccaaaacaaccaucaccgu

SEQ ID NO: 625 - RNA, 19 nt, Artificial Sequence
  source: /note="Description of Artificial Sequence: Synthetic oligonucleotide"
uuaccuguugaauuuuguu

SEQ ID NO: 626 - RNA, 19 nt, Artificial Sequence
  source: /note="Description of Artificial Sequence: Synthetic oligonucleotide"
cuacaguggccuuaucccu

SEQ ID NO: 627 - RNA, 19 nt, Artificial Sequence
  source: /note="Description of Artificial Sequence: Synthetic oligonucleotide"
cuaauacaucagcaugcgu

SEQ ID NO: 628 - RNA, 19 nt, Artificial Sequence
  source: /note="Description of Artificial Sequence: Synthetic oligonucleotide"
ccagauaugcccgacgauu

SEQ ID NO: 629 - RNA, 19 nt, Artificial Sequence
  source: /note="Description of Artificial Sequence: Synthetic oligonucleotide"
cauugcgauuguccagagu

SEQ ID NO: 630 - RNA, 19 nt, Artificial Sequence
  source: /note="Description of Artificial Sequence: Synthetic oligonucleotide"
gaggauauuuggaugcauu

SEQ ID NO: 631 - RNA, 19 nt, Artificial Sequence
  source: /note="Description of Artificial Sequence: Synthetic oligonucleotide"
gguccaaagacgaagucgu

SEQ ID NO: 632 - RNA, 19 nt, Artificial Sequence
  source: /note="Description of Artificial Sequence: Synthetic oligonucleotide"
ugagugacaacguacccuu

SEQ ID NO: 633 - RNA, 19 nt, Artificial Sequence
  source: /note="Description of Artificial Sequence: Synthetic oligonucleotide"
ggaaucugccauugcgauu

SEQ ID NO: 634 - RNA, 19 nt, Artificial Sequence
  source: /note="Description of Artificial Sequence: Synthetic oligonucleotide"
gagauaugccuucgaggau

SEQ ID NO: 635 - RNA, 19 nt, Artificial Sequence
  source: /note="Description of Artificial Sequence: Synthetic oligonucleotide"
ucaccuaacuaaaauaauu

SEQ ID NO: 636 - RNA, 19 nt, Artificial Sequence
  source: /note="Description of Artificial Sequence: Synthetic oligonucleotide"
acguacccuucauugaugu

SEQ ID NO: 637 - RNA, 19 nt, Artificial Sequence
  source: /note="Description of Artificial Sequence: Synthetic oligonucleotide"
cuguuccagcaugagguuu

SEQ ID NO: 638 - RNA, 19 nt, Artificial Sequence
  source: /note="Description of Artificial Sequence: Synthetic oligonucleotide"
uguuaccuguugaauuuuu

SEQ ID NO: 639 - RNA, 19 nt, Artificial Sequence
  source: /note="Description of Artificial Sequence: Synthetic oligonucleotide"
uugaaccuggcuuauuuuu

SEQ ID NO: 640 - RNA, 19 nt, Artificial Sequence
  source: /note="Description of Artificial Sequence: Synthetic oligonucleotide"
ggcccuauuaauggucagu

SEQ ID NO: 641 - RNA, 19 nt, Artificial Sequence
  source: /note="Description of Artificial Sequence: Synthetic oligonucleotide"
cgguccaaagacgaagucu

SEQ ID NO: 642 - RNA, 19 nt, Artificial Sequence
  source: /note="Description of Artificial Sequence: Synthetic oligonucleotide"
cugaguugguuuuaugaau

SEQ ID NO: 643 - RNA, 19 nt, Artificial Sequence
  source: /note="Description of Artificial Sequence: Synthetic oligonucleotide"
ucugccauugcgauugucu

SEQ ID NO: 644 - RNA, 19 nt, Artificial Sequence
  source: /note="Description of Artificial Sequence: Synthetic oligonucleotide"
ggauacaugagcaagauuu

SEQ ID NO: 645 - RNA, 19 nt, Artificial Sequence
  source: /note="Description of Artificial Sequence: Synthetic oligonucleotide"
gggagagauaugccuucgu

SEQ ID NO: 646 - RNA, 19 nt, Artificial Sequence
  source: /note="Description of Artificial Sequence: Synthetic oligonucleotide"
agacgaagucguggaugcu

SEQ ID NO: 647 - RNA, 19 nt, Artificial Sequence
  source: /note="Description of Artificial Sequence: Synthetic oligonucleotide"
gggaaccucuaccuucucu

SEQ ID NO: 648 - RNA, 19 nt, Artificial Sequence
  source: /note="Description of Artificial Sequence: Synthetic oligonucleotide"
cuugcuacccauuaggauu

SEQ ID NO: 649 - RNA, 19 nt, Artificial Sequence
  source: /note="Description of Artificial Sequence: Synthetic oligonucleotide"
aagacgaagucguggaugu

SEQ ID NO: 650 - RNA, 19 nt, Artificial Sequence
  source: /note="Description of Artificial Sequence: Synthetic oligonucleotide"
acaaagguggauacaugau

SEQ ID NO: 651 - RNA, 19 nt, Artificial Sequence
  source: /note="Description of Artificial Sequence: Synthetic oligonucleotide"
cagauaugcccgacgaugu

SEQ ID NO: 652 - RNA, 19 nt, Artificial Sequence
  source: /note="Description of Artificial Sequence: Synthetic oligonucleotide"
cauugcuguguagugaccu

SEQ ID NO: 653 - RNA, 19 nt, Artificial Sequence
  source: /note="Description of Artificial Sequence: Synthetic oligonucleotide"
ucagcaugcguuaauucau

SEQ ID NO: 654 - RNA, 19 nt, Artificial Sequence
  source: /note="Description of Artificial Sequence: Synthetic oligonucleotide"
uaauacaucagcaugcguu

SEQ ID NO: 655 - RNA, 19 nt, Artificial Sequence
  source: /note="Description of Artificial Sequence: Synthetic oligonucleotide"
auggucagacuguuccagu

SEQ ID NO: 656 - RNA, 19 nt, Artificial Sequence
  source: /note="Description of Artificial Sequence: Synthetic oligonucleotide"
caaagacgaagucguggau

SEQ ID NO: 657 - RNA, 19 nt, Artificial Sequence
  source: /note="Description of Artificial Sequence: Synthetic oligonucleotide"
ccuaacuaaaauaauguuu

SEQ ID NO: 658 - RNA, 19 nt, Artificial Sequence
  source: /note="Description of Artificial Sequence: Synthetic oligonucleotide"
caccuaacuaaaauaaugu

SEQ ID NO: 659 - RNA, 19 nt, Artificial Sequence
  source: /note="Description of Artificial Sequence: Synthetic oligonucleotide"
agauugcaccauuucauuu

SEQ ID NO: 660 - RNA, 19 nt, Artificial Sequence
  source: /note="Description of Artificial Sequence: Synthetic oligonucleotide"
cugcccuaaagucaagucu

SEQ ID NO: 661 - RNA, 19 nt, Artificial Sequence
  source: /note="Description of Artificial Sequence: Synthetic oligonucleotide"
cuucuugggcaauaaaguu

SEQ ID NO: 662 - RNA, 19 nt, Artificial Sequence
  source: /note="Description of Artificial Sequence: Synthetic oligonucleotide"
uaaccuugacuacuaaaau

SEQ ID NO: 663 - RNA, 19 nt, Artificial Sequence
  source: /note="Description of Artificial Sequence: Synthetic oligonucleotide"
augccaaaacaaccaucau

SEQ ID NO: 664 - RNA, 19 nt, Artificial Sequence
  source: /note="Description of Artificial Sequence: Synthetic oligonucleotide"
gcugaguugguuuuaugau

SEQ ID NO: 665 - RNA, 19 nt, Artificial Sequence
  source: /note="Description of Artificial Sequence: Synthetic oligonucleotide"
uccaaagacgaagucgugu

SEQ ID NO: 666 - RNA, 19 nt, Artificial Sequence
  source: /note="Description of Artificial Sequence: Synthetic oligonucleotide"
uucaccuaacuaaaauaau

SEQ ID NO: 667 - RNA, 19 nt, Artificial Sequence
  source: /note="Description of Artificial Sequence: Synthetic oligonucleotide"
uugcuacccauuaggauau

SEQ ID NO: 668 - RNA, 19 nt, Artificial Sequence
  source: /note="Description of Artificial Sequence: Synthetic oligonucleotide"
agauaugccuucgaggauu

SEQ ID NO: 669 - RNA, 19 nt, Artificial Sequence
  source: /note="Description of Artificial Sequence: Synthetic oligonucleotide"
gcccuauuaauggucagau

SEQ ID NO: 670 - RNA, 19 nt, Artificial Sequence
  source: /note="Description of Artificial Sequence: Synthetic oligonucleotide"
acuugcuacccauuaggau

SEQ ID NO: 671 - RNA, 19 nt, Artificial Sequence
  source: /note="Description of Artificial Sequence: Synthetic oligonucleotide"
uaugccuucgaggauauuu

SEQ ID NO: 672 - RNA, 19 nt, Artificial Sequence
  source: /note="Description of Artificial Sequence: Synthetic oligonucleotide"
gcguuaauucagcugguuu

SEQ ID NO: 673 - RNA, 19 nt, Artificial Sequence
  source: /note="Description of Artificial Sequence: Synthetic oligonucleotide"
gagggucccuuacugacuu

SEQ ID NO: 674 - RNA, 19 nt, Artificial Sequence
  source: /note="Description of Artificial Sequence: Synthetic oligonucleotide"
cguucuggugucugacuuu

SEQ ID NO: 675 - RNA, 19 nt, Artificial Sequence
  source: /note="Description of Artificial Sequence: Synthetic oligonucleotide"
uuuucaccuaacuaaaauu

SEQ ID NO: 676 - RNA, 19 nt, Artificial Sequence
  source: /note="Description of Artificial Sequence: Synthetic oligonucleotide"
cauugaugccaaaacaacu

SEQ ID NO: 677 - RNA, 19 nt, Artificial Sequence
  source: /note="Description of Artificial Sequence: Synthetic oligonucleotide"
acuuucgguccaaagacgu

SEQ ID NO: 678 - RNA, 19 nt, Artificial Sequence
  source: /note="Description of Artificial Sequence: Synthetic oligonucleotide"
uaauggucagacuguuccu

SEQ ID NO: 679 - RNA, 19 nt, Artificial Sequence
  source: /note="Description of Artificial Sequence: Synthetic oligonucleotide"
aauggucagacuguuccau

SEQ ID NO: 680 - RNA, 19 nt, Artificial Sequence
  source: /note="Description of Artificial Sequence: Synthetic oligonucleotide"
aagcaaguuccuccgacau

SEQ ID NO: 681 - RNA, 19 nt, Artificial Sequence
  source: /note="Description of Artificial Sequence: Synthetic oligonucleotide"
agcugguugggaaaugacu

SEQ ID NO: 682 - RNA, 19 nt, Artificial Sequence
  source: /note="Description of Artificial Sequence: Synthetic oligonucleotide"
cugggagagauaugccuuu

SEQ ID NO: 683 - RNA, 19 nt, Artificial Sequence
  source: /note="Description of Artificial Sequence: Synthetic oligonucleotide"
gagauguuaguagaauaau

SEQ ID NO: 684 - RNA, 19 nt, Artificial Sequence
  source: /note="Description of Artificial Sequence: Synthetic oligonucleotide"
auaugccuucgaggauauu

SEQ ID NO: 685 - RNA, 19 nt, Artificial Sequence
  source: /note="Description of Artificial Sequence: Synthetic oligonucleotide"
ugcguuaauucagcugguu

SEQ ID NO: 686 - RNA, 19 nt, Artificial Sequence
  source: /note="Description of Artificial Sequence: Synthetic oligonucleotide"
uuguuaccuguugaauuuu

SEQ ID NO: 687 - RNA, 19 nt, Artificial Sequence
  source: /note="Description of Artificial Sequence: Synthetic oligonucleotide"
gcagcuaccuccgcauugu

SEQ ID NO: 688 - RNA, 19 nt, Artificial Sequence
  source: /note="Description of Artificial Sequence: Synthetic oligonucleotide"
ucgguccaaagacgaaguu

SEQ ID NO: 689 - RNA, 19 nt, Artificial Sequence
  source: /note="Description of Artificial Sequence: Synthetic oligonucleotide"
agugacaacguacccuucu

SEQ ID NO: 690 - RNA, 19 nt, Artificial Sequence
  source: /note="Description of Artificial Sequence: Synthetic oligonucleotide"
gucuagcagauucuuucau

SEQ ID NO: 691 - RNA, 19 nt, Artificial Sequence
  source: /note="Description of Artificial Sequence: Synthetic oligonucleotide"
ugcccuaaagucaaguccu

SEQ ID NO: 692 - RNA, 19 nt, Artificial Sequence
  source: /note="Description of Artificial Sequence: Synthetic oligonucleotide"
uccucagaagggauggauu

SEQ ID NO: 693 - RNA, 19 nt, Artificial Sequence
  source: /note="Description of Artificial Sequence: Synthetic oligonucleotide"
caaagguggauacaugagu

SEQ ID NO: 694 - RNA, 19 nt, Artificial Sequence
  source: /note="Description of Artificial Sequence: Synthetic oligonucleotide"
ucuacaguggccuuauccu

SEQ ID NO: 695 - RNA, 19 nt, Artificial Sequence
  source: /note="Description of Artificial Sequence: Synthetic oligonucleotide"
uuucgguccaaagacgaau

SEQ ID NO: 696 - RNA, 19 nt, Artificial Sequence
  source: /note="Description of Artificial Sequence: Synthetic oligonucleotide"
gugagugacaacguacccu

SEQ ID NO: 697 - RNA, 19 nt, Artificial Sequence
  source: /note="Description of Artificial Sequence: Synthetic oligonucleotide"
uucuucuugggcaauaaau

SEQ ID NO: 698 - RNA, 19 nt, Artificial Sequence
  source: /note="Description of Artificial Sequence: Synthetic oligonucleotide"
ugguugggaaaugacaccu

SEQ ID NO: 699 - RNA, 19 nt, Artificial Sequence
  source: /note="Description of Artificial Sequence: Synthetic oligonucleotide"
uuaauggucagacuguucu

SEQ ID NO: 700 - RNA, 19 nt, Artificial Sequence
  source: /note="Description of Artificial Sequence: Synthetic oligonucleotide"
auucagcugguugggaaau

SEQ ID NO: 701 - RNA, 19 nt, Artificial Sequence
  source: /note="Description of Artificial Sequence: Synthetic oligonucleotide"
aaagacgaagucguggauu

SEQ ID NO: 702 - RNA, 19 nt, Artificial Sequence
  source: /note="Description of Artificial Sequence: Synthetic oligonucleotide"
uucgguccaaagacgaagu

SEQ ID NO: 703 - RNA, 19 nt, Artificial Sequence
  source: /note="Description of Artificial Sequence: Synthetic oligonucleotide"
gacuuucgguccaaagacu

SEQ ID NO: 704 - RNA, 19 nt, Artificial Sequence
  source: /note="Description of Artificial Sequence: Synthetic oligonucleotide"
ugcgauuguccagagacuu

SEQ ID NO: 705 - RNA, 19 nt, Artificial Sequence
  source: /note="Description of Artificial Sequence: Synthetic oligonucleotide"
gggcaauaaaguaccugcu

SEQ ID NO: 706 - RNA, 19 nt, Artificial Sequence
  source: /note="Description of Artificial Sequence: Synthetic oligonucleotide"
cuauuaauggucagacugu

SEQ ID NO: 707 - RNA, 19 nt, Artificial Sequence
  source: /note="Description of Artificial Sequence: Synthetic oligonucleotide"
uggauacaugagcaagauu

SEQ ID NO: 708 - RNA, 19 nt, Artificial Sequence
  source: /note="Description of Artificial Sequence: Synthetic oligonucleotide"
accaggaagcccagugcau

SEQ ID NO: 709 - RNA, 19 nt, Artificial Sequence
  source: /note="Description of Artificial Sequence: Synthetic oligonucleotide"
uuuuucaccuaacuaaaau

SEQ ID NO: 710 - RNA, 19 nt, Artificial Sequence
  source: /note="Description of Artificial Sequence: Synthetic oligonucleotide"
uuucaccuaacuaaaauau

SEQ ID NO: 711 - RNA, 19 nt, Artificial Sequence
  source: /note="Description of Artificial Sequence: Synthetic oligonucleotide"
uucuugggcaauaaaguau

SEQ ID NO: 712 - RNA, 19 nt, Artificial Sequence
  source: /note="Description of Artificial Sequence: Synthetic oligonucleotide"
auuacauaagacauuaucc

SEQ ID NO: 713 - RNA, 19 nt, Artificial Sequence
  source: /note="Description of Artificial Sequence: Synthetic oligonucleotide"
aguacguugucacucacuc

SEQ ID NO: 714 - RNA, 19 nt, Artificial Sequence
  source: /note="Description of Artificial Sequence: Synthetic oligonucleotide"
aucgaaggcauaucucucc

SEQ ID NO: 715 - RNA, 19 nt, Artificial Sequence
  source: /note="Description of Artificial Sequence: Synthetic oligonucleotide"
acuggaagccaugucacca

SEQ ID NO: 716 - RNA, 19 nt, Artificial Sequence
  source: /note="Description of Artificial Sequence: Synthetic oligonucleotide"
acaaggcauccacgacuuc

SEQ ID NO: 717 - RNA, 19 nt, Artificial Sequence
  source: /note="Description of Artificial Sequence: Synthetic oligonucleotide"
auacguugucacucacucc

SEQ ID NO: 718 - RNA, 19 nt, Artificial Sequence
  source: /note="Description of Artificial Sequence: Synthetic oligonucleotide"
aauuacauaagacauuauc

SEQ ID NO: 719 - RNA, 19 nt, Artificial Sequence
  source: /note="Description of Artificial Sequence: Synthetic oligonucleotide"
acuagcuuuucauaaaacc

SEQ ID NO: 720 - RNA, 19 nt, Artificial Sequence
  source: /note="Description of Artificial Sequence: Synthetic oligonucleotide"
aacggugaugguuguuuug

SEQ ID NO: 721 - RNA, 19 nt, Artificial Sequence
  source: /note="Description of Artificial Sequence: Synthetic oligonucleotide"
auauccucgaaggcauauc

SEQ ID NO: 722 - RNA, 19 nt, Artificial Sequence
  source: /note="Description of Artificial Sequence: Synthetic oligonucleotide"
aucuggacaaucgcaaugg

SEQ ID NO: 723 - RNA, 19 nt, Artificial Sequence
  source: /note="Description of Artificial Sequence: Synthetic oligonucleotide"
aaagguagagguucccugu

SEQ ID NO: 724 - RNA, 19 nt, Artificial Sequence
  source: /note="Description of Artificial Sequence: Synthetic oligonucleotide"
auuauccuaauggguagca

SEQ ID NO: 725 - RNA, 19 nt, Artificial Sequence
  source: /note="Description of Artificial Sequence: Synthetic oligonucleotide"
aaauacaaaauucaacagg

SEQ ID NO: 726 - RNA, 19 nt, Artificial Sequence
  source: /note="Description of Artificial Sequence: Synthetic oligonucleotide"
agguacguugucacucacu

SEQ ID NO: 727 - RNA, 19 nt, Artificial Sequence
  source: /note="Description of Artificial Sequence: Synthetic oligonucleotide"
aaaggcauccacgacuucg

SEQ ID NO: 728 - RNA, 19 nt, Artificial Sequence
  source: /note="Description of Artificial Sequence: Synthetic oligonucleotide"
auuuaguuaggugaaaaag

SEQ ID NO: 729 - RNA, 19 nt, Artificial Sequence
  source: /note="Description of Artificial Sequence: Synthetic oligonucleotide"
aauuauccuaauggguagc

SEQ ID NO: 730 - RNA, 19 nt, Artificial Sequence
  source: /note="Description of Artificial Sequence: Synthetic oligonucleotide"
aagaaaauaagccagguuc

SEQ ID NO: 731 - RNA, 19 nt, Artificial Sequence
  source: /note="Description of Artificial Sequence: Synthetic oligonucleotide"
acggugaugguuguuuugg

SEQ ID NO: 732 - RNA, 19 nt, Artificial Sequence
  source: /note="Description of Artificial Sequence: Synthetic oligonucleotide"
aacaaaauucaacagguaa

SEQ ID NO: 733 - RNA, 19 nt, Artificial Sequence
  source: /note="Description of Artificial Sequence: Synthetic oligonucleotide"
agggauaaggccacuguag

SEQ ID NO: 734 - RNA, 19 nt, Artificial Sequence
  source: /note="Description of Artificial Sequence: Synthetic oligonucleotide"
acgcaugcugauguauuag

SEQ ID NO: 735 - RNA, 19 nt, Artificial Sequence
  source: /note="Description of Artificial Sequence: Synthetic oligonucleotide"
aaucgucgggcauaucugg

SEQ ID NO: 736 - RNA, 19 nt, Artificial Sequence
  source: /note="Description of Artificial Sequence: Synthetic oligonucleotide"
acucuggacaaucgcaaug

SEQ ID NO: 737 - RNA, 19 nt, Artificial Sequence
  source: /note="Description of Artificial Sequence: Synthetic oligonucleotide"
aaugcauccaaauauccuc

SEQ ID NO: 738 - RNA, 19 nt, Artificial Sequence
  source: /note="Description of Artificial Sequence: Synthetic oligonucleotide"
acgacuucgucuuuggacc

SEQ ID NO: 739 - RNA, 19 nt, Artificial Sequence
  source: /note="Description of Artificial Sequence: Synthetic oligonucleotide"
aaggguacguugucacuca

SEQ ID NO: 740 - RNA, 19 nt, Artificial Sequence
  source: /note="Description of Artificial Sequence: Synthetic oligonucleotide"
aaucgcaauggcagauucc

SEQ ID NO: 741 - RNA, 19 nt, Artificial Sequence
  source: /note="Description of Artificial Sequence: Synthetic oligonucleotide"
auccucgaaggcauaucuc

SEQ ID NO: 742 - RNA, 19 nt, Artificial Sequence
  source: /note="Description of Artificial Sequence: Synthetic oligonucleotide"
aauuauuuuaguuagguga

SEQ ID NO: 743 - RNA, 19 nt, Artificial Sequence
  source: /note="Description of Artificial Sequence: Synthetic oligonucleotide"
acaucaaugaaggguacgu

SEQ ID NO: 744 - RNA, 19 nt, Artificial Sequence
  source: /note="Description of Artificial Sequence: Synthetic oligonucleotide"
aaaccucaugcuggaacag

SEQ ID NO: 745 - RNA, 19 nt, Artificial Sequence
  source: /note="Description of Artificial Sequence: Synthetic oligonucleotide"
aaaaauucaacagguaaca

SEQ ID NO: 746 - RNA, 19 nt, Artificial Sequence
  source: /note="Description of Artificial Sequence: Synthetic oligonucleotide"
aaaaauaagccagguucaa

SEQ ID NO: 747 - RNA, 19 nt, Artificial Sequence
  source: /note="Description of Artificial Sequence: Synthetic oligonucleotide"
acugaccauuaauagggcc

SEQ ID NO: 748 - RNA, 19 nt, Artificial Sequence
  source: /note="Description of Artificial Sequence: Synthetic oligonucleotide"
agacuucgucuuuggaccg

SEQ ID NO: 749 - RNA, 19 nt, Artificial Sequence
  source: /note="Description of Artificial Sequence: Synthetic oligonucleotide"
auucauaaaaccaacucag

SEQ ID NO: 750 - RNA, 19 nt, Artificial Sequence
  source: /note="Description of Artificial Sequence: Synthetic oligonucleotide"
agacaaucgcaauggcaga

SEQ ID NO: 751 - RNA, 19 nt, Artificial Sequence
  source: /note="Description of Artificial Sequence: Synthetic oligonucleotide"
aaaucuugcucauguaucc

SEQ ID NO: 752 - RNA, 19 nt, Artificial Sequence
  source: /note="Description of Artificial Sequence: Synthetic oligonucleotide"
acgaaggcauaucucuccc

SEQ ID NO: 753 - RNA, 19 nt, Artificial Sequence
  source: /note="Description of Artificial Sequence: Synthetic oligonucleotide"
agcauccacgacuucgucu

SEQ ID NO: 754 - RNA, 19 nt, Artificial Sequence
  source: /note="Description of Artificial Sequence: Synthetic oligonucleotide"
agagaagguagagguuccc

SEQ ID NO: 755 - RNA, 19 nt, Artificial Sequence
  source: /note="Description of Artificial Sequence: Synthetic oligonucleotide"
aauccuaauggguagcaag

SEQ ID NO: 756 - RNA, 19 nt, Artificial Sequence
  source: /note="Description of Artificial Sequence: Synthetic oligonucleotide"
acauccacgacuucgucuu

SEQ ID NO: 757 - RNA, 19 nt, Artificial Sequence
  source: /note="Description of Artificial Sequence: Synthetic oligonucleotide"
aucauguauccaccuuugu

SEQ ID NO: 758 - RNA, 19 nt, Artificial Sequence
  source: /note="Description of Artificial Sequence: Synthetic oligonucleotide"
acaucgucgggcauaucug

SEQ ID NO: 759 - RNA, 19 nt, Artificial Sequence
  source: /note="Description of Artificial Sequence: Synthetic oligonucleotide"
aggucacuacacagcaaug

SEQ ID NO: 760 - RNA, 19 nt, Artificial Sequence
  source: /note="Description of Artificial Sequence: Synthetic oligonucleotide"
augaauuaacgcaugcuga

SEQ ID NO: 761 - RNA, 19 nt, Artificial Sequence
  source: /note="Description of Artificial Sequence: Synthetic oligonucleotide"
aacgcaugcugauguauua

SEQ ID NO: 762 - RNA, 19 nt, Artificial Sequence
  source: /note="Description of Artificial Sequence: Synthetic oligonucleotide"
acuggaacagucugaccau

SEQ ID NO: 763 - RNA, 19 nt, Artificial Sequence
  source: /note="Description of Artificial Sequence: Synthetic oligonucleotide"
auccacgacuucgucuuug

SEQ ID NO: 764 - RNA, 19 nt, Artificial Sequence
  source: /note="Description of Artificial Sequence: Synthetic oligonucleotide"
aaacauuauuuuaguuagg

SEQ ID NO: 765 - RNA, 19 nt, Artificial Sequence
  source: /note="Description of Artificial Sequence: Synthetic oligonucleotide"
acauuauuuuaguuaggug

SEQ ID NO: 766 - RNA, 19 nt, Artificial Sequence
  source: /note="Description of Artificial Sequence: Synthetic oligonucleotide"
aaaugaaauggugcaaucu

SEQ ID NO: 767 - RNA, 19 nt, Artificial Sequence
  source: /note="Description of Artificial Sequence: Synthetic oligonucleotide"
agacuugacuuuagggcag

SEQ ID NO: 768 - RNA, 19 nt, Artificial Sequence
  source: /note="Description of Artificial Sequence: Synthetic oligonucleotide"
aacuuuauugcccaagaag

SEQ ID NO: 769 - RNA, 19 nt, Artificial Sequence
  source: /note="Description of Artificial Sequence: Synthetic oligonucleotide"
auuuuaguagucaagguua

SEQ ID NO: 770 - RNA, 19 nt, Artificial Sequence
  source: /note="Description of Artificial Sequence: Synthetic oligonucleotide"
augaugguuguuuuggcau

SEQ ID NO: 771 - RNA, 19 nt, Artificial Sequence
  source: /note="Description of Artificial Sequence: Synthetic oligonucleotide"
aucauaaaaccaacucagc

SEQ ID NO: 772 - RNA, 19 nt, Artificial Sequence
  source: /note="Description of Artificial Sequence: Synthetic oligonucleotide"
acacgacuucgucuuugga

SEQ ID NO: 773 - RNA, 19 nt, Artificial Sequence
  source: /note="Description of Artificial Sequence: Synthetic oligonucleotide"
auuauuuuaguuaggugaa

SEQ ID NO: 774 - RNA, 19 nt, Artificial Sequence
  source: /note="Description of Artificial Sequence: Synthetic oligonucleotide"
auauccuaauggguagcaa

SEQ ID NO: 775 - RNA, 19 nt, Artificial Sequence
  source: /note="Description of Artificial Sequence: Synthetic oligonucleotide"
aauccucgaaggcauaucu

SEQ ID NO: 776 - RNA, 19 nt, Artificial Sequence
  source: /note="Description of Artificial Sequence: Synthetic oligonucleotide"
aucugaccauuaauagggc

SEQ ID NO: 777 - RNA, 19 nt, Artificial Sequence
  source: /note="Description of Artificial Sequence: Synthetic oligonucleotide"
auccuaauggguagcaagu

SEQ ID NO: 778 - RNA, 19 nt, Artificial Sequence
  source: /note="Description of Artificial Sequence: Synthetic oligonucleotide"
aaauauccucgaaggcaua

SEQ ID NO: 779 - RNA, 19 nt, Artificial Sequence
  source: /note="Description of Artificial Sequence: Synthetic oligonucleotide"
aaaccagcugaauuaacgc

SEQ ID NO: 780 - RNA, 19 nt, Artificial Sequence
  source: /note="Description of Artificial Sequence: Synthetic oligonucleotide"
aagucaguaagggacccuc

SEQ ID NO: 781 - RNA, 19 nt, Artificial Sequence
  source: /note="Description of Artificial Sequence: Synthetic oligonucleotide"
aaagucagacaccagaacg

SEQ ID NO: 782 - RNA, 19 nt, Artificial Sequence
  source: /note="Description of Artificial Sequence: Synthetic oligonucleotide"
aauuuuaguuaggugaaaa

SEQ ID NO: 783 - RNA, 19 nt, Artificial Sequence
  source: /note="Description of Artificial Sequence: Synthetic oligonucleotide"
aguuguuuuggcaucaaug

SEQ ID NO: 784 - RNA, 19 nt, Artificial Sequence
  source: /note="Description of Artificial Sequence: Synthetic oligonucleotide"
acgucuuuggaccgaaagu

SEQ ID NO: 785 - RNA, 19 nt, Artificial Sequence
  source: /note="Description of Artificial Sequence: Synthetic oligonucleotide"
aggaacagucugaccauua

SEQ ID NO: 786 - RNA, 19 nt, Artificial Sequence
  source: /note="Description of Artificial Sequence: Synthetic oligonucleotide"
auggaacagucugaccauu

SEQ ID NO: 787 - RNA, 19 nt, Artificial Sequence
  source: /note="Description of Artificial Sequence: Synthetic oligonucleotide"
augucggaggaacuugcuu

SEQ ID NO: 788 - RNA, 19 nt, Artificial Sequence
  source: /note="Description of Artificial Sequence: Synthetic oligonucleotide"
agucauuucccaaccagcu

SEQ ID NO: 789 - RNA, 19 nt, Artificial Sequence
  source: /note="Description of Artificial Sequence: Synthetic oligonucleotide"
aaaggcauaucucucccag

SEQ ID NO: 790 - RNA, 19 nt, Artificial Sequence
  source: /note="Description of Artificial Sequence: Synthetic oligonucleotide"
auuauucuacuaacaucuc

SEQ ID NO: 791 - RNA, 19 nt, Artificial Sequence
  source: /note="Description of Artificial Sequence: Synthetic oligonucleotide"
aauauccucgaaggcauau

SEQ ID NO: 792 - RNA, 19 nt, Artificial Sequence
  source: /note="Description of Artificial Sequence: Synthetic oligonucleotide"
aaccagcugaauuaacgca

SEQ ID NO: 793 - RNA, 19 nt, Artificial Sequence
  source: /note="Description of Artificial Sequence: Synthetic oligonucleotide"
aaaauucaacagguaacaa

SEQ ID NO: 794 - RNA, 19 nt, Artificial Sequence
  source: /note="Description of Artificial Sequence: Synthetic oligonucleotide"
acaaugcggagguagcugc

SEQ ID NO: 795 - RNA, 19 nt, Artificial Sequence
  source: /note="Description of Artificial Sequence: Synthetic oligonucleotide"
aacuucgucuuuggaccga

SEQ ID NO: 796 - RNA, 19 nt, Artificial Sequence
  source: /note="Description of Artificial Sequence: Synthetic oligonucleotide"
agaaggguacguugucacu

SEQ ID NO: 797 - RNA, 19 nt, Artificial Sequence
  source: /note="Description of Artificial Sequence: Synthetic oligonucleotide"
augaaagaaucugcuagac

SEQ ID NO: 798 - RNA, 19 nt, Artificial Sequence
  source: /note="Description of Artificial Sequence: Synthetic oligonucleotide"
aggacuugacuuuagggca

SEQ ID NO: 799 - RNA, 19 nt, Artificial Sequence
  source: /note="Description of Artificial Sequence: Synthetic oligonucleotide"
aauccaucccuucugagga

SEQ ID NO: 800 - RNA, 19 nt, Artificial Sequence
  source: /note="Description of Artificial Sequence: Synthetic oligonucleotide"
acucauguauccaccuuug

SEQ ID NO: 801 - RNA, 19 nt, Artificial Sequence
  source: /note="Description of Artificial Sequence: Synthetic oligonucleotide"
aggauaaggccacuguaga

SEQ ID NO: 802 - RNA, 19 nt, Artificial Sequence
  source: /note="Description of Artificial Sequence: Synthetic oligonucleotide"
auucgucuuuggaccgaaa

SEQ ID NO: 803 - RNA, 19 nt, Artificial Sequence
  source: /note="Description of Artificial Sequence: Synthetic oligonucleotide"
aggguacguugucacucac

SEQ ID NO: 804 - RNA, 19 nt, Artificial Sequence
  source: /note="Description of Artificial Sequence: Synthetic oligonucleotide"
auuuauugcccaagaagaa

SEQ ID NO: 805 - RNA, 19 nt, Artificial Sequence
  source: /note="Description of Artificial Sequence: Synthetic oligonucleotide"
aggugucauuucccaacca

SEQ ID NO: 806 - RNA, 19 nt, Artificial Sequence
  source: /note="Description of Artificial Sequence: Synthetic oligonucleotide"
agaacagucugaccauuaa

SEQ ID NO: 807 - RNA, 19 nt, Artificial Sequence
  source: /note="Description of Artificial Sequence: Synthetic oligonucleotide"
auuucccaaccagcugaau

SEQ ID NO: 808 - RNA, 19 nt, Artificial Sequence
  source: /note="Description of Artificial Sequence: Synthetic oligonucleotide"
aauccacgacuucgucuuu

SEQ ID NO: 809 - RNA, 19 nt, Artificial Sequence
  source: /note="Description of Artificial Sequence: Synthetic oligonucleotide"
acuucgucuuuggaccgaa

SEQ ID NO: 810 - RNA, 19 nt, Artificial Sequence
  source: /note="Description of Artificial Sequence: Synthetic oligonucleotide"
agucuuuggaccgaaaguc

SEQ ID NO: 811 - RNA, 19 nt, Artificial Sequence
  source: /note="Description of Artificial Sequence: Synthetic oligonucleotide"
aagucucuggacaaucgca

SEQ ID NO: 812 - RNA, 19 nt, Artificial Sequence
  source: /note="Description of Artificial Sequence: Synthetic oligonucleotide"
agcagguacuuuauugccc

SEQ ID NO: 813 - RNA, 19 nt, Artificial Sequence
  source: /note="Description of Artificial Sequence: Synthetic oligonucleotide"
acagucugaccauuaauag

SEQ ID NO: 814 - RNA, 19 nt, Artificial Sequence
  source: /note="Description of Artificial Sequence: Synthetic oligonucleotide"
aaucuugcucauguaucca

SEQ ID NO: 815 - RNA, 19 nt, Artificial Sequence
  source: /note="Description of Artificial Sequence: Synthetic oligonucleotide"
augcacugggcuuccuggu

SEQ ID NO: 816 - RNA, 19 nt, Artificial Sequence
  source: /note="Description of Artificial Sequence: Synthetic oligonucleotide"
auuuuaguuaggugaaaaa

SEQ ID NO: 817 - RNA, 19 nt, Artificial Sequence
  source: /note="Description of Artificial Sequence: Synthetic oligonucleotide"
auauuuuaguuaggugaaa

SEQ ID NO: 818 - RNA, 19 nt, Artificial Sequence
  source: /note="Description of Artificial Sequence: Synthetic oligonucleotide"
auacuuuauugcccaagaa

SEQ ID NO: 819 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggauaaugucuuauguaautt

SEQ ID NO: 820 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagugagugacaacguacutt

SEQ ID NO: 821 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagagauaugccuucgautt

SEQ ID NO: 822 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugacauggcuuccagutt

SEQ ID NO: 823 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagucguggaugccuugutt

SEQ ID NO: 824 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagugagugacaacguautt

SEQ ID NO: 825 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauaaugucuuauguaauutt

SEQ ID NO: 826 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuuuaugaaaagcuagutt

SEQ ID NO: 827 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaacaaccaucaccguutt

SEQ ID NO: 828 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauaugccuucgaggauautt

SEQ ID NO: 829 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauugcgauuguccagautt

SEQ ID NO: 830 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagggaaccucuaccuuutt

SEQ ID NO: 831 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuacccauuaggauaautt

SEQ ID NO: 832 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuguugaauuuuguauuutt

SEQ ID NO: 833 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugagugacaacguaccutt

SEQ ID NO: 834 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaagucguggaugccuuutt

SEQ ID NO: 835 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuuucaccuaacuaaautt

SEQ ID NO: 836 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuacccauuaggauaauutt

SEQ ID NO: 837 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaccuggcuuauuuucuutt

SEQ ID NO: 838 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaaaacaaccaucaccgutt

SEQ ID NO: 839 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaccuguugaauuuuguutt

SEQ ID NO: 840 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacaguggccuuaucccutt

SEQ ID NO: 841 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaauacaucagcaugcgutt

SEQ ID NO: 842 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagauaugcccgacgauutt

SEQ ID NO: 843 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauugcgauuguccagagutt

SEQ ID NO: 844 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggauauuuggaugcauutt

SEQ ID NO: 845 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguccaaagacgaagucgutt

SEQ ID NO: 846 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagugacaacguacccuutt

SEQ ID NO: 847 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaucugccauugcgauutt

SEQ ID NO: 848 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagauaugccuucgaggautt

SEQ ID NO: 849 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccuaacuaaaauaauutt

SEQ ID NO: 850 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acguacccuucauugaugutt

SEQ ID NO: 851 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguuccagcaugagguuutt

SEQ ID NO: 852 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuaccuguugaauuuuutt

SEQ ID NO: 853 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaaccuggcuuauuuuutt

SEQ ID NO: 854 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcccuauuaauggucagutt

SEQ ID NO: 855 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgguccaaagacgaagucutt

SEQ ID NO: 856 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaguugguuuuaugaautt

SEQ ID NO: 857 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugccauugcgauugucutt

SEQ ID NO: 858 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggauacaugagcaagauuutt

SEQ ID NO: 859 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggagagauaugccuucgutt

SEQ ID NO: 860 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacgaagucguggaugcutt

SEQ ID NO: 861 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaaccucuaccuucucutt

SEQ ID NO: 862 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugcuacccauuaggauutt

SEQ ID NO: 863 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagacgaagucguggaugutt

SEQ ID NO: 864 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaagguggauacaugautt

SEQ ID NO: 865 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagauaugcccgacgaugutt

SEQ ID NO: 866 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauugcuguguagugaccutt

SEQ ID NO: 867 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcaugcguuaauucautt

SEQ ID NO: 868 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauacaucagcaugcguutt

SEQ ID NO: 869 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggucagacuguuccagutt

SEQ ID NO: 870 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaagacgaagucguggautt

SEQ ID NO: 871 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuaacuaaaauaauguuutt

SEQ ID NO: 872 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccuaacuaaaauaaugutt

SEQ ID NO: 873 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauugcaccauuucauuutt

SEQ ID NO: 874 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcccuaaagucaagucutt

SEQ ID NO: 875 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuugggcaauaaaguutt

SEQ ID NO: 876 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaccuugacuacuaaaautt

SEQ ID NO: 877 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augccaaaacaaccaucautt

SEQ ID NO: 878 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugaguugguuuuaugautt

SEQ ID NO: 879 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaaagacgaagucgugutt

SEQ ID NO: 880 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaccuaacuaaaauaautt

SEQ ID NO: 881 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcuacccauuaggauautt

SEQ ID NO: 882 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauaugccuucgaggauutt

SEQ ID NO: 883 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccuauuaauggucagautt

SEQ ID NO: 884 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuugcuacccauuaggautt

SEQ ID NO: 885 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugccuucgaggauauuutt

SEQ ID NO: 886 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcguuaauucagcugguuutt

SEQ ID NO: 887 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagggucccuuacugacuutt

SEQ ID NO: 888 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguucuggugucugacuuutt

SEQ ID NO: 889 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuucaccuaacuaaaauutt

SEQ ID NO: 890 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauugaugccaaaacaacutt

SEQ ID NO: 891 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuucgguccaaagacgutt

SEQ ID NO: 892 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauggucagacuguuccutt

SEQ ID NO: 893 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauggucagacuguuccautt

SEQ ID NO: 894 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcaaguuccuccgacautt

SEQ ID NO: 895 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugguugggaaaugacutt

SEQ ID NO: 896 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggagagauaugccuuutt

SEQ ID NO: 897 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagauguuaguagaauaautt

SEQ ID NO: 898 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaugccuucgaggauauutt

SEQ ID NO: 899 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcguuaauucagcugguutt

SEQ ID NO: 900 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguuaccuguugaauuuutt

SEQ ID NO: 901 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcuaccuccgcauugutt

SEQ ID NO: 902 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgguccaaagacgaaguutt

SEQ ID NO: 903 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugacaacguacccuucutt

SEQ ID NO: 904 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuagcagauucuuucautt

SEQ ID NO: 905 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccuaaagucaaguccutt

SEQ ID NO: 906 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucagaagggauggauutt

SEQ ID NO: 907 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaagguggauacaugagutt

SEQ ID NO: 908 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuacaguggccuuauccutt

SEQ ID NO: 909 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucgguccaaagacgaautt

SEQ ID NO: 910 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugagugacaacguacccutt

SEQ ID NO: 911 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuucuugggcaauaaautt

SEQ ID NO: 912 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguugggaaaugacaccutt

SEQ ID NO: 913 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaauggucagacuguucutt

SEQ ID NO: 914 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucagcugguugggaaautt

SEQ ID NO: 915 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagacgaagucguggauutt

SEQ ID NO: 916 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgguccaaagacgaagutt

SEQ ID NO: 917 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuuucgguccaaagacutt

SEQ ID NO: 918 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgauuguccagagacuutt

SEQ ID NO: 919 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcaauaaaguaccugcutt

SEQ ID NO: 920 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuauuaauggucagacugutt

SEQ ID NO: 921 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggauacaugagcaagauutt

SEQ ID NO: 922 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaggaagcccagugcautt

SEQ ID NO: 923 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuucaccuaacuaaaautt

SEQ ID NO: 924 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucaccuaacuaaaauautt

SEQ ID NO: 925 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuugggcaauaaaguautt

SEQ ID NO: 926 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuacauaagacauuaucctt

SEQ ID NO: 927 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguacguugucacucacuctt

SEQ ID NO: 928 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgaaggcauaucucucctt

SEQ ID NO: 929 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuggaagccaugucaccatt

SEQ ID NO: 930 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaggcauccacgacuuctt

SEQ ID NO: 931 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacguugucacucacucctt

SEQ ID NO: 932 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuacauaagacauuauctt

SEQ ID NO: 933 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuagcuuuucauaaaacctt

SEQ ID NO: 934 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacggugaugguuguuuugtt

SEQ ID NO: 935 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauccucgaaggcauauctt

SEQ ID NO: 936 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuggacaaucgcaauggtt

SEQ ID NO: 937 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagguagagguucccugutt

SEQ ID NO: 938 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuauccuaauggguagcatt

SEQ ID NO: 939 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauacaaaauucaacaggtt

SEQ ID NO: 940 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguacguugucacucacutt

SEQ ID NO: 941 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaggcauccacgacuucgtt

SEQ ID NO: 942 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuaguuaggugaaaaagtt

SEQ ID NO: 943 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuauccuaauggguagctt

SEQ ID NO: 944 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaaauaagccagguuctt

SEQ ID NO: 945 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acggugaugguuguuuuggtt

SEQ ID NO: 946 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaaaauucaacagguaatt

SEQ ID NO: 947 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggauaaggccacuguagtt

SEQ ID NO: 948 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgcaugcugauguauuagtt

SEQ ID NO: 949 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucgucgggcauaucuggtt

SEQ ID NO: 950 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucuggacaaucgcaaugtt

SEQ ID NO: 951 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugcauccaaauauccuctt

SEQ ID NO: 952 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgacuucgucuuuggacctt

SEQ ID NO: 953 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggguacguugucacucatt

SEQ ID NO: 954 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucgcaauggcagauucctt

SEQ ID NO: 955 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccucgaaggcauaucuctt

SEQ ID NO: 956 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuauuuuaguuaggugatt

SEQ ID NO: 957 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaucaaugaaggguacgutt

SEQ ID NO: 958 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaccucaugcuggaacagtt

SEQ ID NO: 959 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaauucaacagguaacatt

SEQ ID NO: 960 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaauaagccagguucaatt

SEQ ID NO: 961 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugaccauuaauagggcctt

SEQ ID NO: 962 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacuucgucuuuggaccgtt

SEQ ID NO: 963 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucauaaaaccaacucagtt

SEQ ID NO: 964 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacaaucgcaauggcagatt

SEQ ID NO: 965 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaucuugcucauguaucctt

SEQ ID NO: 966 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaaggcauaucucuccctt

SEQ ID NO: 967 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcauccacgacuucgucutt

SEQ ID NO: 968 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagaagguagagguuccctt

SEQ ID NO: 969 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauccuaauggguagcaagtt

SEQ ID NO: 970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauccacgacuucgucuutt

SEQ ID NO: 971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucauguauccaccuuugutt

SEQ ID NO: 972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaucgucgggcauaucugtt

SEQ ID NO: 973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggucacuacacagcaaugtt

SEQ ID NO: 974 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaauuaacgcaugcugatt

SEQ ID NO: 975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacgcaugcugauguauuatt

SEQ ID NO: 976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuggaacagucugaccautt

SEQ ID NO: 977 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccacgacuucgucuuugtt

SEQ ID NO: 978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacauuauuuuaguuaggtt

SEQ ID NO: 979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauuauuuuaguuaggugtt

SEQ ID NO: 980 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaugaaauggugcaaucutt

SEQ ID NO: 981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacuugacuuuagggcagtt

SEQ ID NO: 982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuuuauugcccaagaagtt

SEQ ID NO: 983 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuaguagucaagguuatt

SEQ ID NO: 984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaugguuguuuuggcautt

SEQ ID NO: 985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucauaaaaccaacucagctt

SEQ ID NO: 986 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacgacuucgucuuuggatt

SEQ ID NO: 987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuauuuuaguuaggugaatt

SEQ ID NO: 988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauccuaauggguagcaatt

SEQ ID NO: 989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauccucgaaggcauaucutt

SEQ ID NO: 990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugaccauuaauagggctt

SEQ ID NO: 991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccuaauggguagcaagutt

SEQ ID NO: 992 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauauccucgaaggcauatt

SEQ ID NO: 993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaccagcugaauuaacgctt

SEQ ID NO: 994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucaguaagggacccuctt

SEQ ID NO: 995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagucagacaccagaacgtt

SEQ ID NO: 996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuuuaguuaggugaaaatt

SEQ ID NO: 997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuguuuuggcaucaaugtt

SEQ ID NO: 998 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgucuuuggaccgaaagutt

SEQ ID NO: 999 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaacagucugaccauuatt

SEQ ID NO: 1000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaacagucugaccauutt

SEQ ID NO: 1001 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augucggaggaacuugcuutt

SEQ ID NO: 1002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucauuucccaaccagcutt

SEQ ID NO: 1003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaggcauaucucucccagtt

SEQ ID NO: 1004 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuauucuacuaacaucuctt

SEQ ID NO: 1005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauauccucgaaggcauautt

SEQ ID NO: 1006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccagcugaauuaacgcatt

SEQ ID NO: 1007 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauucaacagguaacaatt

SEQ ID NO: 1008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaugcggagguagcugctt

SEQ ID NO: 1009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuucgucuuuggaccgatt

SEQ ID NO: 1010 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaggguacguugucacutt

SEQ ID NO: 1011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaaagaaucugcuagactt

SEQ ID NO: 1012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacuugacuuuagggcatt

SEQ ID NO: 1013 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauccaucccuucugaggatt

SEQ ID NO: 1014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucauguauccaccuuugtt

SEQ ID NO: 1015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggauaaggccacuguagatt

SEQ ID NO: 1016 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucgucuuuggaccgaaatt

SEQ ID NO: 1017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggguacguugucacucactt

SEQ ID NO: 1018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuauugcccaagaagaatt

SEQ ID NO: 1019 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugucauuucccaaccatt

SEQ ID NO: 1020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaacagucugaccauuaatt

SEQ ID NO: 1021 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuucccaaccagcugaautt

SEQ ID NO: 1022 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauccacgacuucgucuuutt

SEQ ID NO: 1023 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuucgucuuuggaccgaatt

SEQ ID NO: 1024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucuuuggaccgaaaguctt

SEQ ID NO: 1025 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucucuggacaaucgcatt

SEQ ID NO: 1026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagguacuuuauugccctt

SEQ ID NO: 1027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagucugaccauuaauagtt

SEQ ID NO: 1028 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucuugcucauguauccatt

SEQ ID NO: 1029 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcacugggcuuccuggutt

SEQ ID NO: 1030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuaguuaggugaaaaatt

SEQ ID NO: 1031 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauuuuaguuaggugaaatt

SEQ ID NO: 1032 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacuuuauugcccaagaatt

SEQ ID NO: 1033 - RNA, 19 nt, Artificial Sequence
  source: /note="Description of Artificial Sequence: Synthetic oligonucleotide"
ggauaaugucuuauguaau

SEQ ID NO: 1034 - RNA, 19 nt, Artificial Sequence
  source: /note="Description of Artificial Sequence: Synthetic oligonucleotide"
gagugagugacaacguacc

SEQ ID NO: 1035 - RNA, 19 nt, Artificial Sequence
  source: /note="Description of Artificial Sequence: Synthetic oligonucleotide"
ggagagauaugccuucgag

SEQ ID NO: 1036 - RNA, 19 nt, Artificial Sequence
  source: /note="Description of Artificial Sequence: Synthetic oligonucleotide"
uggugacauggcuuccaga

SEQ ID NO: 1037 - RNA, 19 nt, Artificial Sequence
  source: /note="Description of Artificial Sequence: Synthetic oligonucleotide"
gaagucguggaugccuugg

SEQ ID NO: 1038 - RNA, 19 nt, Artificial Sequence
  source: /note="Description of Artificial Sequence: Synthetic oligonucleotide"
ggagugagugacaacguac

SEQ ID NO: 1039 - RNA, 19 nt, Artificial Sequence
  source: /note="Description of Artificial Sequence: Synthetic oligonucleotide"
gauaaugucuuauguaaug

SEQ ID NO: 1040 - RNA, 19 nt, Artificial Sequence
  source: /note="Description of Artificial Sequence: Synthetic oligonucleotide"
gguuuuaugaaaagcuagg

SEQ ID NO: 1041 - RNA, 19 nt, Artificial Sequence
  source: /note="Description of Artificial Sequence: Synthetic oligonucleotide"
caaaacaaccaucaccgug

SEQ ID NO: 1042 - RNA, 19 nt, Artificial Sequence
  source: /note="Description of Artificial Sequence: Synthetic oligonucleotide"
gauaugccuucgaggauau

SEQ ID NO: 1043 - RNA, 19 nt, Artificial Sequence
  source: /note="Description of Artificial Sequence: Synthetic oligonucleotide"
ccauugcgauuguccagag

SEQ ID NO: 1044 - RNA, 19 nt, Artificial Sequence
  source: /note="Description of Artificial Sequence: Synthetic oligonucleotide"
acagggaaccucuaccuuc

SEQ ID NO: 1045 - RNA, 19 nt, Artificial Sequence
  source: /note="Description of Artificial Sequence: Synthetic oligonucleotide"
ugcuacccauuaggauaau

SEQ ID NO: 1046 - RNA, 19 nt, Artificial Sequence
  source: /note="Description of Artificial Sequence: Synthetic oligonucleotide"
ccuguugaauuuuguauua

SEQ ID NO: 1047 - RNA, 19 nt, Artificial Sequence
  source: /note="Description of Artificial Sequence: Synthetic oligonucleotide"
agugagugacaacguaccc

SEQ ID NO: 1048 - RNA, 19 nt, Artificial Sequence
  source: /note="Description of Artificial Sequence: Synthetic oligonucleotide"
cgaagucguggaugccuug

SEQ ID NO: 1049 - RNA, 19 nt, Artificial Sequence
  source: /note="Description of Artificial Sequence: Synthetic oligonucleotide"
cuuuuucaccuaacuaaaa

SEQ ID NO: 1050 - RNA, 19 nt, Artificial Sequence
  source: /note="Description of Artificial Sequence: Synthetic oligonucleotide"
gcuacccauuaggauaaug

SEQ ID NO: 1051 - RNA, 19 nt, Artificial Sequence
  source: /note="Description of Artificial Sequence: Synthetic oligonucleotide"
gaaccuggcuuauuuucug

SEQ ID NO: 1052 - RNA, 19 nt, Artificial Sequence
  source: /note="Description of Artificial Sequence: Synthetic oligonucleotide"
ccaaaacaaccaucaccgu

SEQ ID NO: 1053 - RNA, 19 nt, Artificial Sequence
  source: /note="Description of Artificial Sequence: Synthetic oligonucleotide"
uuaccuguugaauuuugua

SEQ ID NO: 1054 - RNA, 19 nt, Artificial Sequence
  source: /note="Description of Artificial Sequence: Synthetic oligonucleotide"
cuacaguggccuuaucccu

SEQ ID NO: 1055 - RNA, 19 nt, Artificial Sequence
  source: /note="Description of Artificial Sequence: Synthetic oligonucleotide"
cuaauacaucagcaugcgu

SEQ ID NO: 1056 - RNA, 19 nt, Artificial Sequence
  source: /note="Description of Artificial Sequence: Synthetic oligonucleotide"
ccagauaugcccgacgaug

SEQ ID NO: 1057 - RNA, 19 nt, Artificial Sequence
  source: /note="Description of Artificial Sequence: Synthetic oligonucleotide"
cauugcgauuguccagaga

SEQ ID NO: 1058 - RNA, 19 nt, Artificial Sequence
  source: /note="Description of Artificial Sequence: Synthetic oligonucleotide"
gaggauauuuggaugcauu

SEQ ID NO: 1059 - RNA, 19 nt, Artificial Sequence
  source: /note="Description of Artificial Sequence: Synthetic oligonucleotide"
gguccaaagacgaagucgu

SEQ ID NO: 1060 - RNA, 19 nt, Artificial Sequence
  source: /note="Description of Artificial Sequence: Synthetic oligonucleotide"
ugagugacaacguacccuu

SEQ ID NO: 1061 - RNA, 19 nt, Artificial Sequence
  source: /note="Description of Artificial Sequence: Synthetic oligonucleotide"
ggaaucugccauugcgauu

SEQ ID NO: 1062 - RNA, 19 nt, Artificial Sequence
  source: /note="Description of Artificial Sequence: Synthetic oligonucleotide"
gagauaugccuucgaggau

SEQ ID NO: 1063 - RNA, 19 nt, Artificial Sequence
  source: /note="Description of Artificial Sequence: Synthetic oligonucleotide"
ucaccuaacuaaaauaaug

SEQ ID NO: 1064 - RNA, 19 nt, Artificial Sequence
  source: /note="Description of Artificial Sequence: Synthetic oligonucleotide"
acguacccuucauugaugc

SEQ ID NO: 1065 - RNA, 19 nt, Artificial Sequence
  source: /note="Description of Artificial Sequence: Synthetic oligonucleotide"
cuguuccagcaugagguuc

SEQ ID NO: 1066 - RNA, 19 nt, Artificial Sequence
  source: /note="Description of Artificial Sequence: Synthetic oligonucleotide"
uguuaccuguugaauuuug

SEQ ID NO: 1067 - RNA, 19 nt, Artificial Sequence
  source: /note="Description of Artificial Sequence: Synthetic oligonucleotide"
uugaaccuggcuuauuuuc

SEQ ID NO: 1068 - RNA, 19 nt, Artificial Sequence
  source: /note="Description of Artificial Sequence: Synthetic oligonucleotide"
ggcccuauuaauggucaga

SEQ ID NO: 1069 - RNA, 19 nt, Artificial Sequence
  source: /note="Description of Artificial Sequence: Synthetic oligonucleotide"
cgguccaaagacgaagucg

SEQ ID NO: 1070 - RNA, 19 nt, Artificial Sequence
  source: /note="Description of Artificial Sequence: Synthetic oligonucleotide"
cugaguugguuuuaugaaa

SEQ ID NO: 1071 - RNA, 19 nt, Artificial Sequence
  source: /note="Description of Artificial Sequence: Synthetic oligonucleotide"
ucugccauugcgauugucc

SEQ ID NO: 1072 - RNA, 19 nt, Artificial Sequence
  source: /note="Description of Artificial Sequence: Synthetic oligonucleotide"
ggauacaugagcaagauuu

SEQ ID NO: 1073 - RNA, 19 nt, Artificial Sequence
  source: /note="Description of Artificial Sequence: Synthetic oligonucleotide"
gggagagauaugccuucga

SEQ ID NO: 1074 - RNA, 19 nt, Artificial Sequence
  source: /note="Description of Artificial Sequence: Synthetic oligonucleotide"
agacgaagucguggaugcc

SEQ ID NO: 1075 - RNA, 19 nt, Artificial Sequence
  source: /note="Description of Artificial Sequence: Synthetic oligonucleotide"
gggaaccucuaccuucucu

SEQ ID NO: 1076 - RNA, 19 nt, Artificial Sequence
  source: /note="Description of Artificial Sequence: Synthetic oligonucleotide"
cuugcuacccauuaggaua

SEQ ID NO: 1077 - RNA, 19 nt, Artificial Sequence
  source: /note="Description of Artificial Sequence: Synthetic oligonucleotide"
aagacgaagucguggaugc

SEQ ID NO: 1078 - RNA, 19 nt, Artificial Sequence
  source: /note="Description of Artificial Sequence: Synthetic oligonucleotide"
acaaagguggauacaugag

SEQ ID NO: 1079 - RNA, 19 nt, Artificial Sequence
  source: /note="Description of Artificial Sequence: Synthetic oligonucleotide"
cagauaugcccgacgaugu

SEQ ID NO: 1080 - RNA, 19 nt, Artificial Sequence
  source: /note="Description of Artificial Sequence: Synthetic oligonucleotide"
cauugcuguguagugaccc

SEQ ID NO: 1081 - RNA, 19 nt, Artificial Sequence
  source: /note="Description of Artificial Sequence: Synthetic oligonucleotide"
ucagcaugcguuaauucag

SEQ ID NO: 1082 - RNA, 19 nt, Artificial Sequence
  source: /note="Description of Artificial Sequence: Synthetic oligonucleotide"
uaauacaucagcaugcguu

SEQ ID NO: 1083 - RNA, 19 nt, Artificial Sequence
  source: /note="Description of Artificial Sequence: Synthetic oligonucleotide"
auggucagacuguuccagc

SEQ ID NO: 1084 - RNA, 19 nt, Artificial Sequence
  source: /note="Description of Artificial Sequence: Synthetic oligonucleotide"
caaagacgaagucguggau

SEQ ID NO: 1085 - RNA, 19 nt, Artificial Sequence
  source: /note="Description of Artificial Sequence: Synthetic oligonucleotide"
ccuaacuaaaauaauguuu

SEQ ID NO: 1086 - RNA, 19 nt, Artificial Sequence
  source: /note="Description of Artificial Sequence: Synthetic oligonucleotide"
caccuaacuaaaauaaugu

SEQ ID NO: 1087 - RNA, 19 nt, Artificial Sequence
  source: /note="Description of Artificial Sequence: Synthetic oligonucleotide"
agauugcaccauuucauuc

SEQ ID NO: 1088 - RNA, 19 nt, Artificial Sequence
  source: /note="Description of Artificial Sequence: Synthetic oligonucleotide"
cugcccuaaagucaagucc

SEQ ID NO: 1089 - RNA, 19 nt, Artificial Sequence
  source: /note="Description of Artificial Sequence: Synthetic oligonucleotide"
cuucuugggcaauaaagua

SEQ ID NO: 1090 - RNA, 19 nt, Artificial Sequence
  source: /note="Description of Artificial Sequence: Synthetic oligonucleotide"
uaaccuugacuacuaaaaa

SEQ ID NO: 1091 - RNA, 19 nt, Artificial Sequence
  source: /note="Description of Artificial Sequence: Synthetic oligonucleotide"
augccaaaacaaccaucac

SEQ ID NO: 1092 - RNA, 19 nt, Artificial Sequence
  source: /note="Description of Artificial Sequence: Synthetic oligonucleotide"
gcugaguugguuuuaugaa

SEQ ID NO: 1093 - RNA, 19 nt, Artificial Sequence
  source: /note="Description of Artificial Sequence: Synthetic oligonucleotide"
uccaaagacgaagucgugg

SEQ ID NO: 1094 - RNA, 19 nt, Artificial Sequence
  source: /note="Description of Artificial Sequence: Synthetic oligonucleotide"
uucaccuaacuaaaauaau

SEQ ID NO: 1095 - RNA, 19 nt, Artificial Sequence
  source: /note="Description of Artificial Sequence: Synthetic oligonucleotide"
uugcuacccauuaggauaa

SEQ ID NO: 1096 - RNA, 19 nt, Artificial Sequence
  source: /note="Description of Artificial Sequence: Synthetic oligonucleotide"
agauaugccuucgaggaua

SEQ ID NO: 1097 - RNA, 19 nt, Artificial Sequence
  source: /note="Description of Artificial Sequence: Synthetic oligonucleotide"
gcccuauuaauggucagac

SEQ ID NO: 1098 - RNA, 19 nt, Artificial Sequence
  source: /note="Description of Artificial Sequence: Synthetic oligonucleotide"
acuugcuacccauuaggau

SEQ ID NO: 1099 - RNA, 19 nt, Artificial Sequence
  source: /note="Description of Artificial Sequence: Synthetic oligonucleotide"
uaugccuucgaggauauuu

SEQ ID NO: 1100 - RNA, 19 nt, Artificial Sequence
  source: /note="Description of Artificial Sequence: Synthetic oligonucleotide"
gcguuaauucagcugguug

SEQ ID NO: 1101 - RNA, 19 nt, Artificial Sequence
  source: /note="Description of Artificial Sequence: Synthetic oligonucleotide"
gagggucccuuacugacug

SEQ ID NO: 1102 - RNA, 19 nt, Artificial Sequence
  source: /note="Description of Artificial Sequence: Synthetic oligonucleotide"
cguucuggugucugacuuu

SEQ ID NO: 1103 - RNA, 19 nt, Artificial Sequence
  source: /note="Description of Artificial Sequence: Synthetic oligonucleotide"
uuuucaccuaacuaaaaua

SEQ ID NO: 1104 - RNA, 19 nt, Artificial Sequence
  source: /note="Description of Artificial Sequence: Synthetic oligonucleotide"
cauugaugccaaaacaacc

SEQ ID NO: 1105 - RNA, 19 nt, Artificial Sequence
  source: /note="Description of Artificial Sequence: Synthetic oligonucleotide"
acuuucgguccaaagacga

SEQ ID NO: 1106 - RNA, 19 nt, Artificial Sequence
  source: /note="Description of Artificial Sequence: Synthetic oligonucleotide"
uaauggucagacuguucca

SEQ ID NO: 1107 - RNA, 19 nt, Artificial Sequence
  source: /note="Description of Artificial Sequence: Synthetic oligonucleotide"
aauggucagacuguuccag

SEQ ID NO: 1108 - RNA, 19 nt, Artificial Sequence
  source: /note="Description of Artificial Sequence: Synthetic oligonucleotide"
aagcaaguuccuccgacag

SEQ ID NO: 1109 - RNA, 19 nt, Artificial Sequence
  source: /note="Description of Artificial Sequence: Synthetic oligonucleotide"
agcugguugggaaaugaca

SEQ ID NO: 1110 - RNA, 19 nt, Artificial Sequence
  source: /note="Description of Artificial Sequence: Synthetic oligonucleotide"
cugggagagauaugccuuc

SEQ ID NO: 1111 - RNA, 19 nt, Artificial Sequence
  source: /note="Description of Artificial Sequence: Synthetic oligonucleotide"
gagauguuaguagaauaag

SEQ ID NO: 1112 - RNA, 19 nt, Artificial Sequence
  source: /note="Description of Artificial Sequence: Synthetic oligonucleotide"
auaugccuucgaggauauu

SEQ ID NO: 1113 - RNA, 19 nt, Artificial Sequence
  source: /note="Description of Artificial Sequence: Synthetic oligonucleotide"
ugcguuaauucagcugguu

SEQ ID NO: 1114 - RNA, 19 nt, Artificial Sequence
  source: /note="Description of Artificial Sequence: Synthetic oligonucleotide"
uuguuaccuguugaauuuu

SEQ ID NO: 1115 - RNA, 19 nt, Artificial Sequence
  source: /note="Description of Artificial Sequence: Synthetic oligonucleotide"
gcagcuaccuccgcauugc

SEQ ID NO: 1116 - RNA, 19 nt, Artificial Sequence
  source: /note="Description of Artificial Sequence: Synthetic oligonucleotide"
ucgguccaaagacgaaguc

SEQ ID NO: 1117 - RNA, 19 nt, Artificial Sequence
  source: /note="Description of Artificial Sequence: Synthetic oligonucleotide"
agugacaacguacccuuca

SEQ ID NO: 1118 - RNA, 19 nt, Artificial Sequence
  source: /note="Description of Artificial Sequence: Synthetic oligonucleotide"
gucuagcagauucuuucag

SEQ ID NO: 1119 - RNA, 19 nt, Artificial Sequence
  source: /note="Description of Artificial Sequence: Synthetic oligonucleotide"
ugcccuaaagucaagucca

SEQ ID NO: 1120 - RNA, 19 nt, Artificial Sequence
  source: /note="Description of Artificial Sequence: Synthetic oligonucleotide"
uccucagaagggauggauc

SEQ ID NO: 1121 - RNA, 19 nt, Artificial Sequence
  source: /note="Description of Artificial Sequence: Synthetic oligonucleotide"
caaagguggauacaugagc

SEQ ID NO: 1122 - RNA, 19 nt, Artificial Sequence
  source: /note="Description of Artificial Sequence: Synthetic oligonucleotide"
ucuacaguggccuuauccc

SEQ ID NO: 1123 - RNA, 19 nt, Artificial Sequence
  source: /note="Description of Artificial Sequence: Synthetic oligonucleotide"
uuucgguccaaagacgaag

SEQ ID NO: 1124 - RNA, 19 nt, Artificial Sequence
  source: /note="Description of Artificial Sequence: Synthetic oligonucleotide"
gugagugacaacguacccu

SEQ ID NO: 1125 - RNA, 19 nt, Artificial Sequence
  source: /note="Description of Artificial Sequence: Synthetic oligonucleotide"
uucuucuugggcaauaaag

SEQ ID NO: 1126 - RNA, 19 nt, Artificial Sequence
  source: /note="Description of Artificial Sequence: Synthetic oligonucleotide"
ugguugggaaaugacacca

SEQ ID NO: 1127 - RNA, 19 nt, Artificial Sequence
  source: /note="Description of Artificial Sequence: Synthetic oligonucleotide"
uuaauggucagacuguucc

SEQ ID NO: 1128 - RNA, 19 nt, Artificial Sequence
  source: /note="Description of Artificial Sequence: Synthetic oligonucleotide"
auucagcugguugggaaau

SEQ ID NO: 1129 - RNA, 19 nt, Artificial Sequence
  source: /note="Description of Artificial Sequence: Synthetic oligonucleotide"
aaagacgaagucguggaug

SEQ ID NO: 1130 - RNA, 19 nt, Artificial Sequence
  source: /note="Description of Artificial Sequence: Synthetic oligonucleotide"
uucgguccaaagacgaagu

SEQ ID NO: 1131 - RNA, 19 nt, Artificial Sequence
  source: /note="Description of Artificial Sequence: Synthetic oligonucleotide"
gacuuucgguccaaagacg

SEQ ID NO: 1132 - RNA, 19 nt, Artificial Sequence
  source: /note="Description of Artificial Sequence: Synthetic oligonucleotide"
ugcgauuguccagagacug

SEQ ID NO: 1133 - RNA, 19 nt, Artificial Sequence
  source: /note="Description of Artificial Sequence: Synthetic oligonucleotide"
gggcaauaaaguaccugcu

SEQ ID NO: 1134 - RNA, 19 nt, Artificial Sequence
  source: /note="Description of Artificial Sequence: Synthetic oligonucleotide"
cuauuaauggucagacugu

SEQ ID NO: 1135 - RNA, 19 nt, Artificial Sequence
  source: /note="Description of Artificial Sequence: Synthetic oligonucleotide"
uggauacaugagcaagauu

SEQ ID NO: 1136 - RNA, 19 nt, Artificial Sequence
  source: /note="Description of Artificial Sequence: Synthetic oligonucleotide"
accaggaagcccagugcag

SEQ ID NO: 1137 - RNA, 19 nt, Artificial Sequence
  source: /note="Description of Artificial Sequence: Synthetic oligonucleotide"
uuuuucaccuaacuaaaau

SEQ ID NO: 1138 - RNA, 19 nt, Artificial Sequence
  source: /note="Description of Artificial Sequence: Synthetic oligonucleotide"
uuucaccuaacuaaaauaa

SEQ ID NO: 1139 - RNA, 19 nt, Artificial Sequence
  source: /note="Description of Artificial Sequence: Synthetic oligonucleotide"
uucuugggcaauaaaguac

SEQ ID NO: 1140 - RNA, 21 nt, Artificial Sequence
  source: /note="Description of Artificial Sequence: Synthetic oligonucleotide"
accuuuuucaccuaacuaaau

SEQ ID NO: 1141 - RNA, 21 nt, Artificial Sequence
  source: /note="Description of Artificial Sequence: Synthetic oligonucleotide"
acaccuuuuucaccuaacuau

SEQ ID NO: 1142 - RNA, 21 nt, Artificial Sequence
  source: /note="Description of Artificial Sequence: Synthetic oligonucleotide"
cuuuuucaccuaacuaaaauu

SEQ ID NO: 1143 - RNA, 21 nt, Artificial Sequence
  source: /note="Description of Artificial Sequence: Synthetic oligonucleotide"
acuuucuucauguggacaucu

SEQ ID NO: 1144 - RNA, 21 nt, Artificial Sequence
  source: /note="Description of Artificial Sequence: Synthetic oligonucleotide"
caccuuuuucaccuaacuaau

SEQ ID NO: 1145 - RNA, 21 nt, Artificial Sequence
  source: /note="Description of Artificial Sequence: Synthetic oligonucleotide"
ccuuuuucaccuaacuaaaau

SEQ ID NO: 1146 - RNA, 21 nt, Artificial Sequence
  source: /note="Description of Artificial Sequence: Synthetic oligonucleotide"
uccaccuuucccaguuuuucu

SEQ ID NO: 1147 - RNA, 21 nt, Artificial Sequence
  source: /note="Description of Artificial Sequence: Synthetic oligonucleotide"
cugaguugguuuuaugaaaau

SEQ ID NO: 1148 - RNA, 21 nt, Artificial Sequence
  source: /note="Description of Artificial Sequence: Synthetic oligonucleotide"
aagauuugcaacuugcuaccu

SEQ ID NO: 1149 - RNA, 21 nt, Artificial Sequence
  source: /note="Description of Artificial Sequence: Synthetic oligonucleotide"
ugagcaagauuugcaacuugu

SEQ ID NO: 1150 - RNA, 21 nt, Artificial Sequence
  source: /note="Description of Artificial Sequence: Synthetic oligonucleotide"
aaacguucuggugucugacuu

SEQ ID NO: 1151 - RNA, 21 nt, Artificial Sequence
  source: /note="Description of Artificial Sequence: Synthetic oligonucleotide"
aacaccuuuuucaccuaacuu

SEQ ID NO: 1152 - RNA, 21 nt, Artificial Sequence
  source: /note="Description of Artificial Sequence: Synthetic oligonucleotide"
ccaccuuucccaguuuuucau

SEQ ID NO: 1153 - RNA, 21 nt, Artificial Sequence
  source: /note="Description of Artificial Sequence: Synthetic oligonucleotide"
cagguccucucagaucuuguu

SEQ ID NO: 1154 - RNA, 21 nt, Artificial Sequence
  source: /note="Description of Artificial Sequence: Synthetic oligonucleotide"
caccuuucccaguuuuucacu

SEQ ID NO: 1155 - RNA, 21 nt, Artificial Sequence
  source: /note="Description of Artificial Sequence: Synthetic oligonucleotide"
aaagacaaagguggauacauu

SEQ ID NO: 1156 - RNA, 21 nt, Artificial Sequence
  source: /note="Description of Artificial Sequence: Synthetic oligonucleotide"
uuuuucaccuaacuaaaauau

SEQ ID NO: 1157 - RNA, 21 nt, Artificial Sequence
  source: /note="Description of Artificial Sequence: Synthetic oligonucleotide"
augagcaagauuugcaacuuu

SEQ ID NO: 1158 - RNA, 21 nt, Artificial Sequence
  source: /note="Description of Artificial Sequence: Synthetic oligonucleotide"
auuugcaacuugcuacccauu

SEQ ID NO: 1159 - RNA, 21 nt, Artificial Sequence
  source: /note="Description of Artificial Sequence: Synthetic oligonucleotide"
gacaacguacccuucauugau

SEQ ID NO: 1160 - RNA, 21 nt, Artificial Sequence
  source: /note="Description of Artificial Sequence: Synthetic oligonucleotide"
uugcuacccauuaggauaauu

SEQ ID NO: 1161 - RNA, 21 nt, Artificial Sequence
  source: /note="Description of Artificial Sequence: Synthetic oligonucleotide"
ugccuucgaggauauuuggau

SEQ ID NO: 1162 - RNA, 21 nt, Artificial Sequence
  source: /note="Description of Artificial Sequence: Synthetic oligonucleotide"
gcugaguugguuuuaugaaau

SEQ ID NO: 1163 - RNA, 21 nt, Artificial Sequence
  source: /note="Description of Artificial Sequence: Synthetic oligonucleotide"
uugcaacuugcuacccauuau

SEQ ID NO: 1164 - RNA, 21 nt, Artificial Sequence
  source: /note="Description of Artificial Sequence: Synthetic oligonucleotide"
cucuccaccuuucccaguuuu

SEQ ID NO: 1165 - RNA, 21 nt, Artificial Sequence
  source: /note="Description of Artificial Sequence: Synthetic oligonucleotide"
uugguuuuaugaaaagcuagu

SEQ ID NO: 1166 - RNA, 21 nt, Artificial Sequence
  source: /note="Description of Artificial Sequence: Synthetic oligonucleotide"
caugagcaagauuugcaacuu

SEQ ID NO: 1167 - RNA, 21 nt, Artificial Sequence
  source: /note="Description of Artificial Sequence: Synthetic oligonucleotide"
ucugagcugaguugguuuuau

SEQ ID NO: 1168 - RNA, 21 nt, Artificial Sequence
  source: /note="Description of Artificial Sequence: Synthetic oligonucleotide"
guacccuucauugaugccaau

SEQ ID NO: 1169 - RNA, 21 nt, Artificial Sequence
  source: /note="Description of Artificial Sequence: Synthetic oligonucleotide"
guccagccugaacuucuucuu

SEQ ID NO: 1170 - RNA, 21 nt, Artificial Sequence
  source: /note="Description of Artificial Sequence: Synthetic oligonucleotide"
cuugcuacccauuaggauaau

SEQ ID NO: 1171 - RNA, 21 nt, Artificial Sequence
  source: /note="Description of Artificial Sequence: Synthetic oligonucleotide"
uggauacaugagcaagauuuu

SEQ ID NO: 1172 - RNA, 21 nt, Artificial Sequence
  source: /note="Description of Artificial Sequence: Synthetic oligonucleotide"
ccuauuaauggucagacuguu

SEQ ID NO: 1173 - RNA, 21 nt, Artificial Sequence
  source: /note="Description of Artificial Sequence: Synthetic oligonucleotide"
ugagcugaguugguuuuaugu

SEQ ID NO: 1174 - RNA, 21 nt, Artificial Sequence
  source: /note="Description of Artificial Sequence: Synthetic oligonucleotide"
aucuuccauccauccuucaau

SEQ ID NO: 1175 - RNA, 21 nt, Artificial Sequence
  source: /note="Description of Artificial Sequence: Synthetic oligonucleotide"
cugagcugaguugguuuuauu

SEQ ID NO: 1176 - RNA, 21 nt, Artificial Sequence
  source: /note="Description of Artificial Sequence: Synthetic oligonucleotide"
caagauuugcaacuugcuacu

SEQ ID NO: 1177 - RNA, 21 nt, Artificial Sequence
  source: /note="Description of Artificial Sequence: Synthetic oligonucleotide"
acaugagcaagauuugcaacu

SEQ ID NO: 1178 - RNA, 21 nt, Artificial Sequence
  source: /note="Description of Artificial Sequence: Synthetic oligonucleotide"
cuauuaauggucagacuguuu

SEQ ID NO: 1179 - RNA, 21 nt, Artificial Sequence
  source: /note="Description of Artificial Sequence: Synthetic oligonucleotide"
agggaaccucuaccuucucuu

SEQ ID NO: 1180 - RNA, 21 nt, Artificial Sequence
  source: /note="Description of Artificial Sequence: Synthetic oligonucleotide"
auuaauggucagacuguuccu

SEQ ID NO: 1181 - RNA, 21 nt, Artificial Sequence
  source: /note="Description of Artificial Sequence: Synthetic oligonucleotide"
caacguacccuucauugaugu

SEQ ID NO: 1182 - RNA, 21 nt, Artificial Sequence
  source: /note="Description of Artificial Sequence: Synthetic oligonucleotide"
uuuuaugaaaagcuaggaagu

SEQ ID NO: 1183 - RNA, 21 nt, Artificial Sequence
  source: /note="Description of Artificial Sequence: Synthetic oligonucleotide"
uaugccuucgaggauauuugu

SEQ ID NO: 1184 - RNA, 21 nt, Artificial Sequence
  source: /note="Description of Artificial Sequence: Synthetic oligonucleotide"
cuccaccuuucccaguuuuuu

SEQ ID NO: 1185 - RNA, 21 nt, Artificial Sequence
  source: /note="Description of Artificial Sequence: Synthetic oligonucleotide"
accuuucccaguuuuucacuu

SEQ ID NO: 1186 - RNA, 21 nt, Artificial Sequence
  source: /note="Description of Artificial Sequence: Synthetic oligonucleotide"
agcaagauuugcaacuugcuu

SEQ ID NO: 1187 - RNA, 21 nt, Artificial Sequence
  source: /note="Description of Artificial Sequence: Synthetic oligonucleotide"
gugacaacguacccuucauuu

SEQ ID NO: 1188 - RNA, 21 nt, Artificial Sequence
  source: /note="Description of Artificial Sequence: Synthetic oligonucleotide"
aguugguuuuaugaaaagcuu

SEQ ID NO: 1189 - RNA, 21 nt, Artificial Sequence
  source: /note="Description of Artificial Sequence: Synthetic oligonucleotide"
cguucuggugucugacuuucu

SEQ ID NO: 1190 - RNA, 21 nt, Artificial Sequence
  source: /note="Description of Artificial Sequence: Synthetic oligonucleotide"
ucugccauugcgauuguccau

SEQ ID NO: 1191 - RNA, 21 nt, Artificial Sequence
  source: /note="Description of Artificial Sequence: Synthetic oligonucleotide"
caugagguucuuagaaugacu

SEQ ID NO: 1192 - RNA, 21 nt, Artificial Sequence
  source: /note="Description of Artificial Sequence: Synthetic oligonucleotide"
ugaguugguuuuaugaaaagu

SEQ ID NO: 1193 - RNA, 21 nt, Artificial Sequence
  source: /note="Description of Artificial Sequence: Synthetic oligonucleotide"
cgguccaaagacgaagucguu

SEQ ID NO: 1194 - RNA, 21 nt, Artificial Sequence
  source: /note="Description of Artificial Sequence: Synthetic oligonucleotide"
acaacguacccuucauugauu

SEQ ID NO: 1195 - RNA, 21 nt, Artificial Sequence
  source: /note="Description of Artificial Sequence: Synthetic oligonucleotide"
agcugaguugguuuuaugaau

SEQ ID NO: 1196 - RNA, 21 nt, Artificial Sequence
  source: /note="Description of Artificial Sequence: Synthetic oligonucleotide"
ugugaaucagugagauguuau

SEQ ID NO: 1197 - RNA, 21 nt, Artificial Sequence
  source: /note="Description of Artificial Sequence: Synthetic oligonucleotide"
auucagguucuuggaagagau

SEQ ID NO: 1198 - RNA, 21 nt, Artificial Sequence
  source: /note="Description of Artificial Sequence: Synthetic oligonucleotide"
aacguucuggugucugacuuu

SEQ ID NO: 1199 - RNA, 21 nt, Artificial Sequence
  source: /note="Description of Artificial Sequence: Synthetic oligonucleotide"
gagcugaguugguuuuaugau

SEQ ID NO: 1200 - RNA, 21 nt, Artificial Sequence
  source: /note="Description of Artificial Sequence: Synthetic oligonucleotide"
aagacaaagguggauacaugu

SEQ ID NO: 1201 - RNA, 21 nt, Artificial Sequence
  source: /note="Description of Artificial Sequence: Synthetic oligonucleotide"
gaguugguuuuaugaaaagcu

SEQ ID NO: 1202 - RNA, 21 nt, Artificial Sequence
  source: /note="Description of Artificial Sequence: Synthetic oligonucleotide"
ugguuuuaugaaaagcuaggu

SEQ ID NO: 1203 - RNA, 21 nt, Artificial Sequence
  source: /note="Description of Artificial Sequence: Synthetic oligonucleotide"
gcaagauuugcaacuugcuau

SEQ ID NO: 1204 - RNA, 21 nt, Artificial Sequence
  source: /note="Description of Artificial Sequence: Synthetic oligonucleotide"
guugguuuuaugaaaagcuau

SEQ ID NO: 1205 - RNA, 21 nt, Artificial Sequence
  source: /note="Description of Artificial Sequence: Synthetic oligonucleotide"
ucuuccauccauccuucaacu

SEQ ID NO: 1206 - RNA, 21 nt, Artificial Sequence
  source: /note="Description of Artificial Sequence: Synthetic oligonucleotide"
uucagguucuuggaagagaau

SEQ ID NO: 1207 - RNA, 21 nt, Artificial Sequence
  source: /note="Description of Artificial Sequence: Synthetic oligonucleotide"
gguccaaagacgaagucgugu

SEQ ID NO: 1208 - RNA, 21 nt, Artificial Sequence
  source: /note="Description of Artificial Sequence: Synthetic oligonucleotide"
uuuaugaaaagcuaggaagcu

SEQ ID NO: 1209 - RNA, 21 nt, Artificial Sequence
  source: /note="Description of Artificial Sequence: Synthetic oligonucleotide"
ugagugacaacguacccuucu

SEQ ID NO: 1210 - RNA, 21 nt, Artificial Sequence
  source: /note="Description of Artificial Sequence: Synthetic oligonucleotide"
cuucauguggacaucaccaau

SEQ ID NO: 1211 - RNA, 21 nt, Artificial Sequence
  source: /note="Description of Artificial Sequence: Synthetic oligonucleotide"
ugaaagacaaagguggauacu

SEQ ID NO: 1212 - RNA, 21 nt, Artificial Sequence
  source: /note="Description of Artificial Sequence: Synthetic oligonucleotide"
ucuccaccuuucccaguuuuu

SEQ ID NO: 1213 - RNA, 21 nt, Artificial Sequence
  source: /note="Description of Artificial Sequence: Synthetic oligonucleotide"
ccugaagucauccucagaagu

SEQ ID NO: 1214 - RNA, 21 nt, Artificial Sequence
  source: /note="Description of Artificial Sequence: Synthetic oligonucleotide"
ucagguucuuggaagagaagu

SEQ ID NO: 1215 - RNA, 21 nt, Artificial Sequence
  source: /note="Description of Artificial Sequence: Synthetic oligonucleotide"
aacuuucuucauguggacauu

SEQ ID NO: 1216 - RNA, 21 nt, Artificial Sequence
  source: /note="Description of Artificial Sequence: Synthetic oligonucleotide"
cagguucuuggaagagaaggu

SEQ ID NO: 1217 - RNA, 21 nt, Artificial Sequence
  source: /note="Description of Artificial Sequence: Synthetic oligonucleotide"
uucuucauguggacaucaccu

SEQ ID NO: 1218 - RNA, 21 nt, Artificial Sequence
  source: /note="Description of Artificial Sequence: Synthetic oligonucleotide"
ugacaacguacccuucauugu

SEQ ID NO: 1219 - RNA, 21 nt, Artificial Sequence
  source: /note="Description of Artificial Sequence: Synthetic oligonucleotide"
uuucuucauguggacaucacu

SEQ ID NO: 1220 - RNA, 21 nt, Artificial Sequence
  source: /note="Description of Artificial Sequence: Synthetic oligonucleotide"
cuuucuucauguggacaucau

SEQ ID NO: 1221 - RNA, 21 nt, Artificial Sequence
  source: /note="Description of Artificial Sequence: Synthetic oligonucleotide"
gagcaagauuugcaacuugcu

SEQ ID NO: 1222 - RNA, 21 nt, Artificial Sequence
  source: /note="Description of Artificial Sequence: Synthetic oligonucleotide"
acguucuggugucugacuuuu

SEQ ID NO: 1223 - RNA, 21 nt, Artificial Sequence
  source: /note="Description of Artificial Sequence: Synthetic oligonucleotide"
ucuucauguggacaucaccau

SEQ ID NO: 1224 - RNA, 21 nt, Artificial Sequence
  source: /note="Description of Artificial Sequence: Synthetic oligonucleotide"
caucugcccuaaagucaaguu

SEQ ID NO: 1225 - RNA, 21 nt, Artificial Sequence
  source: /note="Description of Artificial Sequence: Synthetic oligonucleotide"
uucuuucagaggugcuaaagu

SEQ ID NO: 1226 - RNA, 21 nt, Artificial Sequence
  source: /note="Description of Artificial Sequence: Synthetic oligonucleotide"
cgaacuuucuucauguggacu

SEQ ID NO: 1227 - RNA, 21 nt, Artificial Sequence
  source: /note="Description of Artificial Sequence: Synthetic oligonucleotide"
augccuucgaggauauuuggu

SEQ ID NO: 1228 - RNA, 21 nt, Artificial Sequence
  source: /note="Description of Artificial Sequence: Synthetic oligonucleotide"
aacguacccuucauugaugcu

SEQ ID NO: 1229 - RNA, 21 nt, Artificial Sequence
  source: /note="Description of Artificial Sequence: Synthetic oligonucleotide"
gaacuuucuucauguggacau

SEQ ID NO: 1230 - RNA, 23 nt, Artificial Sequence
  source: /note="Description of Artificial Sequence: Synthetic oligonucleotide"
auuuaguuaggugaaaaaggugu

SEQ ID NO: 1231 - RNA, 23 nt, Artificial Sequence
  source: /note="Description of Artificial Sequence: Synthetic oligonucleotide"
auaguuaggugaaaaagguguuc

SEQ ID NO: 1232 - RNA, 23 nt, Artificial Sequence
  source: /note="Description of Artificial Sequence: Synthetic oligonucleotide"
aauuuuaguuaggugaaaaaggu

SEQ ID NO: 1233 - RNA, 23 nt, Artificial Sequence
  source: /note="Description of Artificial Sequence: Synthetic oligonucleotide"
agauguccacaugaagaaaguuc

SEQ ID NO: 1234 - RNA, 23 nt, Artificial Sequence
  source: /note="Description of Artificial Sequence: Synthetic oligonucleotide"
auuaguuaggugaaaaagguguu

SEQ ID NO: 1235 - RNA, 23 nt, Artificial Sequence
  source: /note="Description of Artificial Sequence: Synthetic oligonucleotide"
auuuuaguuaggugaaaaaggug

SEQ ID NO: 1236 - RNA, 23 nt, Artificial Sequence
  source: /note="Description of Artificial Sequence: Synthetic oligonucleotide"
agaaaaacugggaaagguggaga

SEQ ID NO: 1237 - RNA, 23 nt, Artificial Sequence
  source: /note="Description of Artificial Sequence: Synthetic oligonucleotide"
auuuucauaaaaccaacucagcu

SEQ ID NO: 1238 - RNA, 23 nt, Artificial Sequence
  source: /note="Description of Artificial Sequence: Synthetic oligonucleotide"
agguagcaaguugcaaaucuugc

SEQ ID NO: 1239 - RNA, 23 nt, Artificial Sequence
  source: /note="Description of Artificial Sequence: Synthetic oligonucleotide"
acaaguugcaaaucuugcucaug

SEQ ID NO: 1240 - RNA, 23 nt, Artificial Sequence
  source: /note="Description of Artificial Sequence: Synthetic oligonucleotide"
aagucagacaccagaacguuuuc

SEQ ID NO: 1241 - RNA, 23 nt, Artificial Sequence
  source: /note="Description of Artificial Sequence: Synthetic oligonucleotide"
aaguuaggugaaaaagguguucu

SEQ ID NO: 1242 - RNA, 23 nt, Artificial Sequence
  source: /note="Description of Artificial Sequence: Synthetic oligonucleotide"
augaaaaacugggaaagguggag

SEQ ID NO: 1243 - RNA, 23 nt, Artificial Sequence
  source: /note="Description of Artificial Sequence: Synthetic oligonucleotide"
aacaagaucugagaggaccugca

SEQ ID NO: 1244 - RNA, 23 nt, Artificial Sequence
  source: /note="Description of Artificial Sequence: Synthetic oligonucleotide"
agugaaaaacugggaaaggugga

SEQ ID NO: 1245 - RNA, 23 nt, Artificial Sequence
  source: /note="Description of Artificial Sequence: Synthetic oligonucleotide"
aauguauccaccuuugucuuuca

SEQ ID NO: 1246 - RNA, 23 nt, Artificial Sequence
  source: /note="Description of Artificial Sequence: Synthetic oligonucleotide"
auauuuuaguuaggugaaaaagg

SEQ ID NO: 1247 - RNA, 23 nt, Artificial Sequence
  source: /note="Description of Artificial Sequence: Synthetic oligonucleotide"
aaaguugcaaaucuugcucaugu

SEQ ID NO: 1248 - RNA, 23 nt, Artificial Sequence
  source: /note="Description of Artificial Sequence: Synthetic oligonucleotide"
aauggguagcaaguugcaaaucu

SEQ ID NO: 1249 - RNA, 23 nt, Artificial Sequence
  source: /note="Description of Artificial Sequence: Synthetic oligonucleotide"
aucaaugaaggguacguugucac

SEQ ID NO: 1250 - RNA, 23 nt, Artificial Sequence
  source: /note="Description of Artificial Sequence: Synthetic oligonucleotide"
aauuauccuaauggguagcaagu

SEQ ID NO: 1251 - RNA, 23 nt, Artificial Sequence
  source: /note="Description of Artificial Sequence: Synthetic oligonucleotide"
auccaaauauccucgaaggcaua

SEQ ID NO: 1252 - RNA, 23 nt, Artificial Sequence
  source: /note="Description of Artificial Sequence: Synthetic oligonucleotide"
auuucauaaaaccaacucagcuc

SEQ ID NO: 1253 - RNA, 23 nt, Artificial Sequence
  source: /note="Description of Artificial Sequence: Synthetic oligonucleotide"
auaauggguagcaaguugcaaau

SEQ ID NO: 1254 - RNA, 23 nt, Artificial Sequence
  source: /note="Description of Artificial Sequence: Synthetic oligonucleotide"
aaaacugggaaagguggagagcc

SEQ ID NO: 1255 - RNA, 23 nt, Artificial Sequence
  source: /note="Description of Artificial Sequence: Synthetic oligonucleotide"
acuagcuuuucauaaaaccaacu

SEQ ID NO: 1256 - RNA, 23 nt, Artificial Sequence
  source: /note="Description of Artificial Sequence: Synthetic oligonucleotide"
aaguugcaaaucuugcucaugua

SEQ ID NO: 1257 - RNA, 23 nt, Artificial Sequence
  source: /note="Description of Artificial Sequence: Synthetic oligonucleotide"
auaaaaccaacucagcucagagg

SEQ ID NO: 1258 - RNA, 23 nt, Artificial Sequence
  source: /note="Description of Artificial Sequence: Synthetic oligonucleotide"
auuggcaucaaugaaggguacgu

SEQ ID NO: 1259 - RNA, 23 nt, Artificial Sequence
  source: /note="Description of Artificial Sequence: Synthetic oligonucleotide"
aagaagaaguucaggcuggaccu

SEQ ID NO: 1260 - RNA, 23 nt, Artificial Sequence
  source: /note="Description of Artificial Sequence: Synthetic oligonucleotide"
auuauccuaauggguagcaaguu

SEQ ID NO: 1261 - RNA, 23 nt, Artificial Sequence
  source: /note="Description of Artificial Sequence: Synthetic oligonucleotide"
aaaaucuugcucauguauccacc

SEQ ID NO: 1262 - RNA, 23 nt, Artificial Sequence
  source: /note="Description of Artificial Sequence: Synthetic oligonucleotide"
aacagucugaccauuaauagggc

SEQ ID NO: 1263 - RNA, 23 nt, Artificial Sequence
  source: /note="Description of Artificial Sequence: Synthetic oligonucleotide"
acauaaaaccaacucagcucaga

SEQ ID NO: 1264 - RNA, 23 nt, Artificial Sequence
  source: /note="Description of Artificial Sequence: Synthetic oligonucleotide"
auugaaggauggauggaagaugc

SEQ ID NO: 1265 - RNA, 23 nt, Artificial Sequence
  source: /note="Description of Artificial Sequence: Synthetic oligonucleotide"
aauaaaaccaacucagcucagag

SEQ ID NO: 1266 - RNA, 23 nt, Artificial Sequence
  source: /note="Description of Artificial Sequence: Synthetic oligonucleotide"
aguagcaaguugcaaaucuugcu

SEQ ID NO: 1267 - RNA, 23 nt, Artificial Sequence
  source: /note="Description of Artificial Sequence: Synthetic oligonucleotide"
aguugcaaaucuugcucauguau

SEQ ID NO: 1268 - RNA, 23 nt, Artificial Sequence
  source: /note="Description of Artificial Sequence: Synthetic oligonucleotide"
aaacagucugaccauuaauaggg

SEQ ID NO: 1269 - RNA, 23 nt, Artificial Sequence
  source: /note="Description of Artificial Sequence: Synthetic oligonucleotide"
aagagaagguagagguucccugu

SEQ ID NO: 1270 - RNA, 23 nt, Artificial Sequence
  source: /note="Description of Artificial Sequence: Synthetic oligonucleotide"
aggaacagucugaccauuaauag

SEQ ID NO: 1271 - RNA, 23 nt, Artificial Sequence
  source: /note="Description of Artificial Sequence: Synthetic oligonucleotide"
acaucaaugaaggguacguuguc

SEQ ID NO: 1272 - RNA, 23 nt, Artificial Sequence
  source: /note="Description of Artificial Sequence: Synthetic oligonucleotide"
acuuccuagcuuuucauaaaacc

SEQ ID NO: 1273 - RNA, 23 nt, Artificial Sequence
  source: /note="Description of Artificial Sequence: Synthetic oligonucleotide"
acaaauauccucgaaggcauauc

SEQ ID NO: 1274 - RNA, 23 nt, Artificial Sequence
  source: /note="Description of Artificial Sequence: Synthetic oligonucleotide"
aaaaaacugggaaagguggagag

SEQ ID NO: 1275 - RNA, 23 nt, Artificial Sequence
  source: /note="Description of Artificial Sequence: Synthetic oligonucleotide"
aagugaaaaacugggaaaggugg

SEQ ID NO: 1276 - RNA, 23 nt, Artificial Sequence
  source: /note="Description of Artificial Sequence: Synthetic oligonucleotide"
aagcaaguugcaaaucuugcuca

SEQ ID NO: 1277 - RNA, 23 nt, Artificial Sequence
  source: /note="Description of Artificial Sequence: Synthetic oligonucleotide"
aaaugaaggguacguugucacuc

SEQ ID NO: 1278 - RNA, 23 nt, Artificial Sequence
  source: /note="Description of Artificial Sequence: Synthetic oligonucleotide"
aagcuuuucauaaaaccaacuca

SEQ ID NO: 1279 - RNA, 23 nt, Artificial Sequence
  source: /note="Description of Artificial Sequence: Synthetic oligonucleotide"
agaaagucagacaccagaacguu

SEQ ID NO: 1280 - RNA, 23 nt, Artificial Sequence
  source: /note="Description of Artificial Sequence: Synthetic oligonucleotide"
auggacaaucgcaauggcagauu

SEQ ID NO: 1281 - RNA, 23 nt, Artificial Sequence
  source: /note="Description of Artificial Sequence: Synthetic oligonucleotide"
agucauucuaagaaccucaugcu

SEQ ID NO: 1282 - RNA, 23 nt, Artificial Sequence
  source: /note="Description of Artificial Sequence: Synthetic oligonucleotide"
acuuuucauaaaaccaacucagc

SEQ ID NO: 1283 - RNA, 23 nt, Artificial Sequence
  source: /note="Description of Artificial Sequence: Synthetic oligonucleotide"
aacgacuucgucuuuggaccgaa

SEQ ID NO: 1284 - RNA, 23 nt, Artificial Sequence
  source: /note="Description of Artificial Sequence: Synthetic oligonucleotide"
aaucaaugaaggguacguuguca

SEQ ID NO: 1285 - RNA, 23 nt, Artificial Sequence
  source: /note="Description of Artificial Sequence: Synthetic oligonucleotide"
auucauaaaaccaacucagcuca

SEQ ID NO: 1286 - RNA, 23 nt, Artificial Sequence
  source: /note="Description of Artificial Sequence: Synthetic oligonucleotide"
auaacaucucacugauucacaua

SEQ ID NO: 1287 - RNA, 23 nt, Artificial Sequence
  source: /note="Description of Artificial Sequence: Synthetic oligonucleotide"
aucucuuccaagaaccugaaugc

SEQ ID NO: 1288 - RNA, 23 nt, Artificial Sequence
  source: /note="Description of Artificial Sequence: Synthetic oligonucleotide"
aaagucagacaccagaacguuuu

SEQ ID NO: 1289 - RNA, 23 nt, Artificial Sequence
  source: /note="Description of Artificial Sequence: Synthetic oligonucleotide"
aucauaaaaccaacucagcucag

SEQ ID NO: 1290 - RNA, 23 nt, Artificial Sequence
  source: /note="Description of Artificial Sequence: Synthetic oligonucleotide"
acauguauccaccuuugucuuuc

SEQ ID NO: 1291 - RNA, 23 nt, Artificial Sequence
  source: /note="Description of Artificial Sequence: Synthetic oligonucleotide"
agcuuuucauaaaaccaacucag

SEQ ID NO: 1292 - RNA, 23 nt, Artificial Sequence
  source: /note="Description of Artificial Sequence: Synthetic oligonucleotide"
accuagcuuuucauaaaaccaac

SEQ ID NO: 1293 - RNA, 23 nt, Artificial Sequence
  source: /note="Description of Artificial Sequence: Synthetic oligonucleotide"
auagcaaguugcaaaucuugcuc

SEQ ID NO: 1294 - RNA, 23 nt, Artificial Sequence
  source: /note="Description of Artificial Sequence: Synthetic oligonucleotide"
auagcuuuucauaaaaccaacuc

SEQ ID NO: 1295 - RNA, 23 nt, Artificial Sequence
  source: /note="Description of Artificial Sequence: Synthetic oligonucleotide"
aguugaaggauggauggaagaug

SEQ ID NO: 1296 - RNA, 23 nt, Artificial Sequence
  source: /note="Description of Artificial Sequence: Synthetic oligonucleotide"
auucucuuccaagaaccugaaug

SEQ ID NO: 1297 - RNA, 23 nt, Artificial Sequence
  source: /note="Description of Artificial Sequence: Synthetic oligonucleotide"
acacgacuucgucuuuggaccga

SEQ ID NO: 1298 - RNA, 23 nt, Artificial Sequence
  source: /note="Description of Artificial Sequence: Synthetic oligonucleotide"
agcuuccuagcuuuucauaaaac

SEQ ID NO: 1299 - RNA, 23 nt, Artificial Sequence
  source: /note="Description of Artificial Sequence: Synthetic oligonucleotide"
agaaggguacguugucacucacu

SEQ ID NO: 1300 - RNA, 23 nt, Artificial Sequence
  source: /note="Description of Artificial Sequence: Synthetic oligonucleotide"
auuggugauguccacaugaagaa

SEQ ID NO: 1301 - RNA, 23 nt, Artificial Sequence
  source: /note="Description of Artificial Sequence: Synthetic oligonucleotide"
aguauccaccuuugucuuucauu

SEQ ID NO: 1302 - RNA, 23 nt, Artificial Sequence
  source: /note="Description of Artificial Sequence: Synthetic oligonucleotide"
aaaaacugggaaagguggagagc

SEQ ID NO: 1303 - RNA, 23 nt, Artificial Sequence
  source: /note="Description of Artificial Sequence: Synthetic oligonucleotide"
acuucugaggaugacuucaggcc

SEQ ID NO: 1304 - RNA, 23 nt, Artificial Sequence
  source: /note="Description of Artificial Sequence: Synthetic oligonucleotide"
acuucucuuccaagaaccugaau

SEQ ID NO: 1305 - RNA, 23 nt, Artificial Sequence
  source: /note="Description of Artificial Sequence: Synthetic oligonucleotide"
aauguccacaugaagaaaguucg

SEQ ID NO: 1306 - RNA, 23 nt, Artificial Sequence
  source: /note="Description of Artificial Sequence: Synthetic oligonucleotide"
accuucucuuccaagaaccugaa

SEQ ID NO: 1307 - RNA, 23 nt, Artificial Sequence
  source: /note="Description of Artificial Sequence: Synthetic oligonucleotide"
aggugauguccacaugaagaaag

SEQ ID NO: 1308 - RNA, 23 nt, Artificial Sequence
  source: /note="Description of Artificial Sequence: Synthetic oligonucleotide"
acaaugaaggguacguugucacu

SEQ ID NO: 1309 - RNA, 23 nt, Artificial Sequence
  source: /note="Description of Artificial Sequence: Synthetic oligonucleotide"
agugauguccacaugaagaaagu

SEQ ID NO: 1310 - RNA, 23 nt, Artificial Sequence
  source: /note="Description of Artificial Sequence: Synthetic oligonucleotide"
augauguccacaugaagaaaguu

SEQ ID NO: 1311 - RNA, 23 nt, Artificial Sequence
  source: /note="Description of Artificial Sequence: Synthetic oligonucleotide"
agcaaguugcaaaucuugcucau

SEQ ID NO: 1312 - RNA, 23 nt, Artificial Sequence
  source: /note="Description of Artificial Sequence: Synthetic oligonucleotide"
aaaagucagacaccagaacguuu

SEQ ID NO: 1313 - RNA, 23 nt, Artificial Sequence
  source: /note="Description of Artificial Sequence: Synthetic oligonucleotide"
auggugauguccacaugaagaaa

SEQ ID NO: 1314 - RNA, 23 nt, Artificial Sequence
  source: /note="Description of Artificial Sequence: Synthetic oligonucleotide"
aacuugacuuuagggcagauguc

SEQ ID NO: 1315 - RNA, 23 nt, Artificial Sequence
  source: /note="Description of Artificial Sequence: Synthetic oligonucleotide"
acuuuagcaccucugaaagaauc

SEQ ID NO: 1316 - RNA, 23 nt, Artificial Sequence
  source: /note="Description of Artificial Sequence: Synthetic oligonucleotide"
aguccacaugaagaaaguucgug

SEQ ID NO: 1317 - RNA, 23 nt, Artificial Sequence
  source: /note="Description of Artificial Sequence: Synthetic oligonucleotide"
accaaauauccucgaaggcauau

SEQ ID NO: 1318 - RNA, 23 nt, Artificial Sequence
  source: /note="Description of Artificial Sequence: Synthetic oligonucleotide"
agcaucaaugaaggguacguugu

SEQ ID NO: 1319 - RNA, 23 nt, Artificial Sequence
  source: /note="Description of Artificial Sequence: Synthetic oligonucleotide"
auguccacaugaagaaaguucgu

SEQ ID NO: 1320 - RNA, 21 nt, Artificial Sequence
  source: /note="Description of Artificial Sequence: Synthetic oligonucleotide"
accuuuuucaccuaacuaaau

SEQ ID NO: 1321 - RNA, 21 nt, Artificial Sequence
  source: /note="Description of Artificial Sequence: Synthetic oligonucleotide"
acaccuuuuucaccuaacuau

SEQ ID NO: 1322 - RNA, 21 nt, Artificial Sequence
  source: /note="Description of Artificial Sequence: Synthetic oligonucleotide"
cuuuuucaccuaacuaaaauu

SEQ ID NO: 1323 - RNA, 21 nt, Artificial Sequence
  source: /note="Description of Artificial Sequence: Synthetic oligonucleotide"
acuuucuucauguggacaucu

SEQ ID NO: 1324 - RNA, 21 nt, Artificial Sequence
  source: /note="Description of Artificial Sequence: Synthetic oligonucleotide"
caccuuuuucaccuaacuaau

SEQ ID NO: 1325 - RNA, 21 nt, Artificial Sequence
  source: /note="Description of Artificial Sequence: Synthetic oligonucleotide"
ccuuuuucaccuaacuaaaau

SEQ ID NO: 1326 - RNA, 21 nt, Artificial Sequence
  source: /note="Description of Artificial Sequence: Synthetic oligonucleotide"
uccaccuuucccaguuuuucu

SEQ ID NO: 1327 - RNA, 21 nt, Artificial Sequence
  source: /note="Description of Artificial Sequence: Synthetic oligonucleotide"
cugaguugguuuuaugaaaau

SEQ ID NO: 1328 - RNA, 21 nt, Artificial Sequence
  source: /note="Description of Artificial Sequence: Synthetic oligonucleotide"
aagauuugcaacuugcuaccu

SEQ ID NO: 1329 - RNA, 21 nt, Artificial Sequence
  source: /note="Description of Artificial Sequence: Synthetic oligonucleotide"
ugagcaagauuugcaacuugu

SEQ ID NO: 1330 - RNA, 21 nt, Artificial Sequence
  source: /note="Description of Artificial Sequence: Synthetic oligonucleotide"
aaacguucuggugucugacuu

SEQ ID NO: 1331 - RNA, 21 nt, Artificial Sequence
  source: /note="Description of Artificial Sequence: Synthetic oligonucleotide"
aacaccuuuuucaccuaacuu

SEQ ID NO: 1332 - RNA, 21 nt, Artificial Sequence
  source: /note="Description of Artificial Sequence: Synthetic oligonucleotide"
ccaccuuucccaguuuuucau

SEQ ID NO: 1333 - RNA, 21 nt, Artificial Sequence
  source: /note="Description of Artificial Sequence: Synthetic oligonucleotide"
cagguccucucagaucuuguu

SEQ ID NO: 1334 - RNA, 21 nt, Artificial Sequence
  source: /note="Description of Artificial Sequence: Synthetic oligonucleotide"
caccuuucccaguuuuucacu

SEQ ID NO: 1335 - RNA, 21 nt, Artificial Sequence
  source: /note="Description of Artificial Sequence: Synthetic oligonucleotide"
aaagacaaagguggauacauu

SEQ ID NO: 1336 - RNA, 21 nt, Artificial Sequence
  source: /note="Description of Artificial Sequence: Synthetic oligonucleotide"
uuuuucaccuaacuaaaauau

SEQ ID NO: 1337 - RNA, 21 nt, Artificial Sequence
  source: /note="Description of Artificial Sequence: Synthetic oligonucleotide"
augagcaagauuugcaacuuu

SEQ ID NO: 1338 - RNA, 21 nt, Artificial Sequence
  source: /note="Description of Artificial Sequence: Synthetic oligonucleotide"
auuugcaacuugcuacccauu

SEQ ID NO: 1339 - RNA, 21 nt, Artificial Sequence
  source: /note="Description of Artificial Sequence: Synthetic oligonucleotide"
gacaacguacccuucauugau

SEQ ID NO: 1340 - RNA, 21 nt, Artificial Sequence
  source: /note="Description of Artificial Sequence: Synthetic oligonucleotide"
uugcuacccauuaggauaauu

SEQ ID NO: 1341 - RNA, 21 nt, Artificial Sequence
  source: /note="Description of Artificial Sequence: Synthetic oligonucleotide"
ugccuucgaggauauuuggau

SEQ ID NO: 1342 - RNA, 21 nt, Artificial Sequence
  source: /note="Description of Artificial Sequence: Synthetic oligonucleotide"
gcugaguugguuuuaugaaau

SEQ ID NO: 1343 - RNA, 21 nt, Artificial Sequence
  source: /note="Description of Artificial Sequence: Synthetic oligonucleotide"
uugcaacuugcuacccauuau

SEQ ID NO: 1344 - RNA, 21 nt, Artificial Sequence
  source: /note="Description of Artificial Sequence: Synthetic oligonucleotide"
cucuccaccuuucccaguuuu

SEQ ID NO: 1345 - RNA, 21 nt, Artificial Sequence
  source: /note="Description of Artificial Sequence: Synthetic oligonucleotide"
uugguuuuaugaaaagcuagu

SEQ ID NO: 1346 - RNA, 21 nt, Artificial Sequence
  source: /note="Description of Artificial Sequence: Synthetic oligonucleotide"
caugagcaagauuugcaacuu

SEQ ID NO: 1347 - RNA, 21 nt, Artificial Sequence
  source: /note="Description of Artificial Sequence: Synthetic oligonucleotide"
ucugagcugaguugguuuuau

SEQ ID NO: 1348 - RNA, 21 nt, Artificial Sequence
  source: /note="Description of Artificial Sequence: Synthetic oligonucleotide"
guacccuucauugaugccaau

SEQ ID NO: 1349 - RNA, 21 nt, Artificial Sequence
  source: /note="Description of Artificial Sequence: Synthetic oligonucleotide"
guccagccugaacuucuucuu

SEQ ID NO: 1350 - RNA, 21 nt, Artificial Sequence
  source: /note="Description of Artificial Sequence: Synthetic oligonucleotide"
cuugcuacccauuaggauaau

SEQ ID NO: 1351 - RNA, 21 nt, Artificial Sequence
  source: /note="Description of Artificial Sequence: Synthetic oligonucleotide"
uggauacaugagcaagauuuu

SEQ ID NO: 1352 - RNA, 21 nt, Artificial Sequence
  source: /note="Description of Artificial Sequence: Synthetic oligonucleotide"
ccuauuaauggucagacuguu

SEQ ID NO: 1353 - RNA, 21 nt, Artificial Sequence
  source: /note="Description of Artificial Sequence: Synthetic oligonucleotide"
ugagcugaguugguuuuaugu

SEQ ID NO: 1354 - RNA, 21 nt, Artificial Sequence
  source: /note="Description of Artificial Sequence: Synthetic oligonucleotide"
aucuuccauccauccuucaau

SEQ ID NO: 1355 - RNA, 21 nt, Artificial Sequence
  source: /note="Description of Artificial Sequence: Synthetic oligonucleotide"
cugagcugaguugguuuuauu

SEQ ID NO: 1356 - RNA, 21 nt, Artificial Sequence
  source: /note="Description of Artificial Sequence: Synthetic oligonucleotide"
caagauuugcaacuugcuacu

SEQ ID NO: 1357 - RNA, 21 nt, Artificial Sequence
  source: /note="Description of Artificial Sequence: Synthetic oligonucleotide"
acaugagcaagauuugcaacu

SEQ ID NO: 1358 - RNA, 21 nt, Artificial Sequence
  source: /note="Description of Artificial Sequence: Synthetic oligonucleotide"
cuauuaauggucagacuguuu

SEQ ID NO: 1359 - RNA, 21 nt, Artificial Sequence
  source: /note="Description of Artificial Sequence: Synthetic oligonucleotide"
agggaaccucuaccuucucuu

SEQ ID NO: 1360 - RNA, 21 nt, Artificial Sequence
  source: /note="Description of Artificial Sequence: Synthetic oligonucleotide"
auuaauggucagacuguuccu

SEQ ID NO: 1361 - RNA, 21 nt, Artificial Sequence
  source: /note="Description of Artificial Sequence: Synthetic oligonucleotide"
caacguacccuucauugaugu

SEQ ID NO: 1362 - RNA, 21 nt, Artificial Sequence
  source: /note="Description of Artificial Sequence: Synthetic oligonucleotide"
uuuuaugaaaagcuaggaagu

SEQ ID NO: 1363 - RNA, 21 nt, Artificial Sequence
  source: /note="Description of Artificial Sequence: Synthetic oligonucleotide"
uaugccuucgaggauauuugu

SEQ ID NO: 1364 - RNA, 21 nt, Artificial Sequence
  source: /note="Description of Artificial Sequence: Synthetic oligonucleotide"
cuccaccuuucccaguuuuuu

SEQ ID NO: 1365 - RNA, 21 nt, Artificial Sequence
  source: /note="Description of Artificial Sequence: Synthetic oligonucleotide"
accuuucccaguuuuucacuu

SEQ ID NO: 1366 - RNA, 21 nt, Artificial Sequence
  source: /note="Description of Artificial Sequence: Synthetic oligonucleotide"
agcaagauuugcaacuugcuu

SEQ ID NO: 1367 - RNA, 21 nt, Artificial Sequence
  source: /note="Description of Artificial Sequence: Synthetic oligonucleotide"
gugacaacguacccuucauuu

SEQ ID NO: 1368 - RNA, 21 nt, Artificial Sequence
  source: /note="Description of Artificial Sequence: Synthetic oligonucleotide"
aguugguuuuaugaaaagcuu

SEQ ID NO: 1369 - RNA, 21 nt, Artificial Sequence
  source: /note="Description of Artificial Sequence: Synthetic oligonucleotide"
cguucuggugucugacuuucu

SEQ ID NO: 1370 - RNA, 21 nt, Artificial Sequence
  source: /note="Description of Artificial Sequence: Synthetic oligonucleotide"
ucugccauugcgauuguccau

SEQ ID NO: 1371 - RNA, 21 nt, Artificial Sequence
  source: /note="Description of Artificial Sequence: Synthetic oligonucleotide"
caugagguucuuagaaugacu

SEQ ID NO: 1372 - RNA, 21 nt, Artificial Sequence
  source: /note="Description of Artificial Sequence: Synthetic oligonucleotide"
ugaguugguuuuaugaaaagu

SEQ ID NO: 1373 - RNA, 21 nt, Artificial Sequence
  source: /note="Description of Artificial Sequence: Synthetic oligonucleotide"
cgguccaaagacgaagucguu

SEQ ID NO: 1374 - RNA, 21 nt, Artificial Sequence
  source: /note="Description of Artificial Sequence: Synthetic oligonucleotide"
acaacguacccuucauugauu

SEQ ID NO: 1375 - RNA, 21 nt, Artificial Sequence
  source: /note="Description of Artificial Sequence: Synthetic oligonucleotide"
agcugaguugguuuuaugaau

SEQ ID NO: 1376 - RNA, 21 nt, Artificial Sequence
  source: /note="Description of Artificial Sequence: Synthetic oligonucleotide"
ugugaaucagugagauguuau

SEQ ID NO: 1377 - RNA, 21 nt, Artificial Sequence
  source: /note="Description of Artificial Sequence: Synthetic oligonucleotide"
auucagguucuuggaagagau

SEQ ID NO: 1378 - RNA, 21 nt, Artificial Sequence
  source: /note="Description of Artificial Sequence: Synthetic oligonucleotide"
aacguucuggugucugacuuu

SEQ ID NO: 1379 - RNA, 21 nt, Artificial Sequence
  source: /note="Description of Artificial Sequence: Synthetic oligonucleotide"
gagcugaguugguuuuaugau

SEQ ID NO: 1380 - RNA, 21 nt, Artificial Sequence
  source: /note="Description of Artificial Sequence: Synthetic oligonucleotide"
aagacaaagguggauacaugu

SEQ ID NO: 1381 - RNA, 21 nt, Artificial Sequence
  source: /note="Description of Artificial Sequence: Synthetic oligonucleotide"
gaguugguuuuaugaaaagcu

SEQ ID NO: 1382 - RNA, 21 nt, Artificial Sequence
  source: /note="Description of Artificial Sequence: Synthetic oligonucleotide"
ugguuuuaugaaaagcuaggu

SEQ ID NO: 1383 - RNA, 21 nt, Artificial Sequence
  source: /note="Description of Artificial Sequence: Synthetic oligonucleotide"
gcaagauuugcaacuugcuau

SEQ ID NO: 1384 - RNA, 21 nt, Artificial Sequence
  source: /note="Description of Artificial Sequence: Synthetic oligonucleotide"
guugguuuuaugaaaagcuau

SEQ ID NO: 1385 - RNA, 21 nt, Artificial Sequence
  source: /note="Description of Artificial Sequence: Synthetic oligonucleotide"
ucuuccauccauccuucaacu

SEQ ID NO: 1386 - RNA, 21 nt, Artificial Sequence
  source: /note="Description of Artificial Sequence: Synthetic oligonucleotide"
uucagguucuuggaagagaau

SEQ ID NO: 1387 - RNA, 21 nt, Artificial Sequence
  source: /note="Description of Artificial Sequence: Synthetic oligonucleotide"
gguccaaagacgaagucgugu

SEQ ID NO: 1388 - RNA, 21 nt, Artificial Sequence
  source: /note="Description of Artificial Sequence: Synthetic oligonucleotide"
uuuaugaaaagcuaggaagcu

SEQ ID NO: 1389 - RNA, 21 nt, Artificial Sequence
  source: /note="Description of Artificial Sequence: Synthetic oligonucleotide"
ugagugacaacguacccuucu

SEQ ID NO: 1390 - RNA, 21 nt, Artificial Sequence
  source: /note="Description of Artificial Sequence: Synthetic oligonucleotide"
cuucauguggacaucaccaau

SEQ ID NO: 1391 - RNA, 21 nt, Artificial Sequence
  source: /note="Description of Artificial Sequence: Synthetic oligonucleotide"
ugaaagacaaagguggauacu

SEQ ID NO: 1392 - RNA, 21 nt, Artificial Sequence
  source: /note="Description of Artificial Sequence: Synthetic oligonucleotide"
ucuccaccuuucccaguuuuu

SEQ ID NO: 1393 - RNA, 21 nt, Artificial Sequence
  source: /note="Description of Artificial Sequence: Synthetic oligonucleotide"
ccugaagucauccucagaagu

SEQ ID NO: 1394 - RNA, 21 nt, Artificial Sequence
  source: /note="Description of Artificial Sequence: Synthetic oligonucleotide"
ucagguucuuggaagagaagu

SEQ ID NO: 1395 - RNA, 21 nt, Artificial Sequence
  source: /note="Description of Artificial Sequence: Synthetic oligonucleotide"
aacuuucuucauguggacauu

SEQ ID NO: 1396 - RNA, 21 nt, Artificial Sequence
  source: /note="Description of Artificial Sequence: Synthetic oligonucleotide"
cagguucuuggaagagaaggu

SEQ ID NO: 1397 - RNA, 21 nt, Artificial Sequence
  source: /note="Description of Artificial Sequence: Synthetic oligonucleotide"
uucuucauguggacaucaccu

SEQ ID NO: 1398 - RNA, 21 nt, Artificial Sequence
  source: /note="Description of Artificial Sequence: Synthetic oligonucleotide"
ugacaacguacccuucauugu

SEQ ID NO: 1399 - RNA, 21 nt, Artificial Sequence
  source: /note="Description of Artificial Sequence: Synthetic oligonucleotide"
uuucuucauguggacaucacu

SEQ ID NO: 1400 - RNA, 21 nt, Artificial Sequence
  source: /note="Description of Artificial Sequence: Synthetic oligonucleotide"
cuuucuucauguggacaucau

SEQ ID NO: 1401 - RNA, 21 nt, Artificial Sequence
  source: /note="Description of Artificial Sequence: Synthetic oligonucleotide"
gagcaagauuugcaacuugcu

SEQ ID NO: 1402 - RNA, 21 nt, Artificial Sequence
  source: /note="Description of Artificial Sequence: Synthetic oligonucleotide"
acguucuggugucugacuuuu

SEQ ID NO: 1403 - RNA, 21 nt, Artificial Sequence
  source: /note="Description of Artificial Sequence: Synthetic oligonucleotide"
ucuucauguggacaucaccau

SEQ ID NO: 1404 - RNA, 21 nt, Artificial Sequence
  source: /note="Description of Artificial Sequence: Synthetic oligonucleotide"
caucugcccuaaagucaaguu

SEQ ID NO: 1405 - RNA, 21 nt, Artificial Sequence
  source: /note="Description of Artificial Sequence: Synthetic oligonucleotide"
uucuuucagaggugcuaaagu

SEQ ID NO: 1406 - RNA, 21 nt, Artificial Sequence
  source: /note="Description of Artificial Sequence: Synthetic oligonucleotide"
cgaacuuucuucauguggacu

SEQ ID NO: 1407 - RNA, 21 nt, Artificial Sequence
  source: /note="Description of Artificial Sequence: Synthetic oligonucleotide"
augccuucgaggauauuuggu

SEQ ID NO: 1408 - RNA, 21 nt, Artificial Sequence
  source: /note="Description of Artificial Sequence: Synthetic oligonucleotide"
aacguacccuucauugaugcu

SEQ ID NO: 1409 - RNA, 21 nt, Artificial Sequence
  source: /note="Description of Artificial Sequence: Synthetic oligonucleotide"
gaacuuucuucauguggacau

SEQ ID NO: 1410 - RNA, 23 nt, Artificial Sequence
  source: /note="Description of Artificial Sequence: Synthetic oligonucleotide"
auuuaguuaggugaaaaaggugu

SEQ ID NO: 1411 - RNA, 23 nt, Artificial Sequence
  source: /note="Description of Artificial Sequence: Synthetic oligonucleotide"
auaguuaggugaaaaagguguuc

SEQ ID NO: 1412 - RNA, 23 nt, Artificial Sequence
  source: /note="Description of Artificial Sequence: Synthetic oligonucleotide"
aauuuuaguuaggugaaaaaggu

SEQ ID NO: 1413 - RNA, 23 nt, Artificial Sequence
  source: /note="Description of Artificial Sequence: Synthetic oligonucleotide"
agauguccacaugaagaaaguuc

SEQ ID NO: 1414 - RNA, 23 nt, Artificial Sequence
  source: /note="Description of Artificial Sequence: Synthetic oligonucleotide"
auuaguuaggugaaaaagguguu

SEQ ID NO: 1415 - RNA, 23 nt, Artificial Sequence
  source: /note="Description of Artificial Sequence: Synthetic oligonucleotide"
auuuuaguuaggugaaaaaggug

SEQ ID NO: 1416 - RNA, 23 nt, Artificial Sequence
  source: /note="Description of Artificial Sequence: Synthetic oligonucleotide"
agaaaaacugggaaagguggaga

SEQ ID NO: 1417 - RNA, 23 nt, Artificial Sequence
  source: /note="Description of Artificial Sequence: Synthetic oligonucleotide"
auuuucauaaaaccaacucagcu

SEQ ID NO: 1418 - RNA, 23 nt, Artificial Sequence
  source: /note="Description of Artificial Sequence: Synthetic oligonucleotide"
agguagcaaguugcaaaucuugc

SEQ ID NO: 1419 - RNA, 23 nt, Artificial Sequence
  source: /note="Description of Artificial Sequence: Synthetic oligonucleotide"
acaaguugcaaaucuugcucaug

SEQ ID NO: 1420 - RNA, 23 nt, Artificial Sequence
  source: /note="Description of Artificial Sequence: Synthetic oligonucleotide"
aagucagacaccagaacguuuuc

SEQ ID NO: 1421 - RNA, 23 nt, Artificial Sequence
  source: /note="Description of Artificial Sequence: Synthetic oligonucleotide"
aaguuaggugaaaaagguguucu

SEQ ID NO: 1422 - RNA, 23 nt, Artificial Sequence
  source: /note="Description of Artificial Sequence: Synthetic oligonucleotide"
augaaaaacugggaaagguggag

SEQ ID NO: 1423 - RNA, 23 nt, Artificial Sequence
  source: /note="Description of Artificial Sequence: Synthetic oligonucleotide"
aacaagaucugagaggaccugca

SEQ ID NO: 1424 - RNA, 23 nt, Artificial Sequence
  source: /note="Description of Artificial Sequence: Synthetic oligonucleotide"
agugaaaaacugggaaaggugga

SEQ ID NO: 1425 - RNA, 23 nt, Artificial Sequence
  source: /note="Description of Artificial Sequence: Synthetic oligonucleotide"
aauguauccaccuuugucuuuca

SEQ ID NO: 1426 - RNA, 23 nt, Artificial Sequence
  source: /note="Description of Artificial Sequence: Synthetic oligonucleotide"
auauuuuaguuaggugaaaaagg

SEQ ID NO: 1427 - RNA, 23 nt, Artificial Sequence
  source: /note="Description of Artificial Sequence: Synthetic oligonucleotide"
aaaguugcaaaucuugcucaugu

SEQ ID NO: 1428 - RNA, 23 nt, Artificial Sequence
  source: /note="Description of Artificial Sequence: Synthetic oligonucleotide"
aauggguagcaaguugcaaaucu

SEQ ID NO: 1429 - RNA, 23 nt, Artificial Sequence
  source: /note="Description of Artificial Sequence: Synthetic oligonucleotide"
aucaaugaaggguacguugucac

SEQ ID NO: 1430 - RNA, 23 nt, Artificial Sequence
  source: /note="Description of Artificial Sequence: Synthetic oligonucleotide"
aauuauccuaauggguagcaagu

SEQ ID NO: 1431 - RNA, 23 nt, Artificial Sequence
  source: /note="Description of Artificial Sequence: Synthetic oligonucleotide"
auccaaauauccucgaaggcaua

SEQ ID NO: 1432 - RNA, 23 nt, Artificial Sequence
  source: /note="Description of Artificial Sequence: Synthetic oligonucleotide"
auuucauaaaaccaacucagcuc

SEQ ID NO: 1433 - RNA, 23 nt, Artificial Sequence
  source: /note="Description of Artificial Sequence: Synthetic oligonucleotide"
auaauggguagcaaguugcaaau

SEQ ID NO: 1434 - RNA, 23 nt, Artificial Sequence
  source: /note="Description of Artificial Sequence: Synthetic oligonucleotide"
aaaacugggaaagguggagagcc

SEQ ID NO: 1435 - RNA, 23 nt, Artificial Sequence
  source: /note="Description of Artificial Sequence: Synthetic oligonucleotide"
acuagcuuuucauaaaaccaacu

SEQ ID NO: 1436 - RNA, 23 nt, Artificial Sequence
  source: /note="Description of Artificial Sequence: Synthetic oligonucleotide"
aaguugcaaaucuugcucaugua

SEQ ID NO: 1437 - RNA, 23 nt, Artificial Sequence
  source: /note="Description of Artificial Sequence: Synthetic oligonucleotide"
auaaaaccaacucagcucagagg

SEQ ID NO: 1438 - RNA, 23 nt, Artificial Sequence
  source: /note="Description of Artificial Sequence: Synthetic oligonucleotide"
auuggcaucaaugaaggguacgu

SEQ ID NO: 1439 - RNA, 23 nt, Artificial Sequence
  source: /note="Description of Artificial Sequence: Synthetic oligonucleotide"
aagaagaaguucaggcuggaccu

SEQ ID NO: 1440 - RNA, 23 nt, Artificial Sequence
  source: /note="Description of Artificial Sequence: Synthetic oligonucleotide"
auuauccuaauggguagcaaguu

SEQ ID NO: 1441 - RNA, 23 nt, Artificial Sequence
  source: /note="Description of Artificial Sequence: Synthetic oligonucleotide"
aaaaucuugcucauguauccacc

SEQ ID NO: 1442 - RNA, 23 nt, Artificial Sequence
  source: /note="Description of Artificial Sequence: Synthetic oligonucleotide"
aacagucugaccauuaauagggc

SEQ ID NO: 1443 - RNA, 23 nt, Artificial Sequence
  source: /note="Description of Artificial Sequence: Synthetic oligonucleotide"
acauaaaaccaacucagcucaga

SEQ ID NO: 1444 - RNA, 23 nt, Artificial Sequence
  source: /note="Description of Artificial Sequence: Synthetic oligonucleotide"
auugaaggauggauggaagaugc

SEQ ID NO: 1445 - RNA, 23 nt, Artificial Sequence
  source: /note="Description of Artificial Sequence: Synthetic oligonucleotide"
aauaaaaccaacucagcucagag

SEQ ID NO: 1446 - RNA, 23 nt, Artificial Sequence
  source: /note="Description of Artificial Sequence: Synthetic oligonucleotide"
aguagcaaguugcaaaucuugcu

SEQ ID NO: 1447 - RNA, 23 nt, Artificial Sequence
  source: /note="Description of Artificial Sequence: Synthetic oligonucleotide"
aguugcaaaucuugcucauguau

SEQ ID NO: 1448 - RNA, 23 nt, Artificial Sequence
  source: /note="Description of Artificial Sequence: Synthetic oligonucleotide"
aaacagucugaccauuaauaggg

SEQ ID NO: 1449 - RNA, 23 nt, Artificial Sequence
  source: /note="Description of Artificial Sequence: Synthetic oligonucleotide"
aagagaagguagagguucccugu

SEQ ID NO: 1450 - RNA, 23 nt, Artificial Sequence
  source: /note="Description of Artificial Sequence: Synthetic oligonucleotide"
aggaacagucugaccauuaauag

SEQ ID NO: 1451 - RNA, 23 nt, Artificial Sequence
  source: /note="Description of Artificial Sequence: Synthetic oligonucleotide"
acaucaaugaaggguacguuguc

SEQ ID NO: 1452 - RNA, 23 nt, Artificial Sequence
  source: /note="Description of Artificial Sequence: Synthetic oligonucleotide"
acuuccuagcuuuucauaaaacc

SEQ ID NO: 1453 - RNA, 23 nt, Artificial Sequence
  source: /note="Description of Artificial Sequence: Synthetic oligonucleotide"
acaaauauccucgaaggcauauc

SEQ ID NO: 1454 - RNA, 23 nt, Artificial Sequence
  source: /note="Description of Artificial Sequence: Synthetic oligonucleotide"
aaaaaacugggaaagguggagag

SEQ ID NO: 1455 - RNA, 23 nt, Artificial Sequence
  source: /note="Description of Artificial Sequence: Synthetic oligonucleotide"
aagugaaaaacugggaaaggugg

SEQ ID NO: 1456 - RNA, 23 nt, Artificial Sequence
  source: /note="Description of Artificial Sequence: Synthetic oligonucleotide"
aagcaaguugcaaaucuugcuca

SEQ ID NO: 1457 - RNA, 23 nt, Artificial Sequence
  source: /note="Description of Artificial Sequence: Synthetic oligonucleotide"
aaaugaaggguacguugucacuc

SEQ ID NO: 1458 - RNA, 23 nt, Artificial Sequence
  source: /note="Description of Artificial Sequence: Synthetic oligonucleotide"
aagcuuuucauaaaaccaacuca

SEQ ID NO: 1459 - RNA, 23 nt, Artificial Sequence
  source: /note="Description of Artificial Sequence: Synthetic oligonucleotide"
agaaagucagacaccagaacguu

SEQ ID NO: 1460 - RNA, 23 nt, Artificial Sequence
  source: /note="Description of Artificial Sequence: Synthetic oligonucleotide"
auggacaaucgcaauggcagauu

SEQ ID NO: 1461 - RNA, 23 nt, Artificial Sequence
  source: /note="Description of Artificial Sequence: Synthetic oligonucleotide"
agucauucuaagaaccucaugcu

SEQ ID NO: 1462 - RNA, 23 nt, Artificial Sequence
  source: /note="Description of Artificial Sequence: Synthetic oligonucleotide"
acuuuucauaaaaccaacucagc

SEQ ID NO: 1463 - RNA, 23 nt, Artificial Sequence
  source: /note="Description of Artificial Sequence: Synthetic oligonucleotide"
aacgacuucgucuuuggaccgaa

SEQ ID NO: 1464 - RNA, 23 nt, Artificial Sequence
  source: /note="Description of Artificial Sequence: Synthetic oligonucleotide"
aaucaaugaaggguacguuguca

SEQ ID NO: 1465 - RNA, 23 nt, Artificial Sequence
  source: /note="Description of Artificial Sequence: Synthetic oligonucleotide"
auucauaaaaccaacucagcuca

SEQ ID NO: 1466 - RNA, 23 nt, Artificial Sequence
  source: /note="Description of Artificial Sequence: Synthetic oligonucleotide"
auaacaucucacugauucacaua

SEQ ID NO: 1467 - RNA, 23 nt, Artificial Sequence
  source: /note="Description of Artificial Sequence: Synthetic oligonucleotide"
aucucuuccaagaaccugaaugc

SEQ ID NO: 1468 - RNA, 23 nt, Artificial Sequence
  source: /note="Description of Artificial Sequence: Synthetic oligonucleotide"
aaagucagacaccagaacguuuu

SEQ ID NO: 1469 - RNA, 23 nt, Artificial Sequence
  source: /note="Description of Artificial Sequence: Synthetic oligonucleotide"
aucauaaaaccaacucagcucag

SEQ ID NO: 1470 - RNA, 23 nt, Artificial Sequence
  source: /note="Description of Artificial Sequence: Synthetic oligonucleotide"
acauguauccaccuuugucuuuc

SEQ ID NO: 1471 - RNA, 23 nt, Artificial Sequence
  source: /note="Description of Artificial Sequence: Synthetic oligonucleotide"
agcuuuucauaaaaccaacucag

SEQ ID NO: 1472 - RNA, 23 nt, Artificial Sequence
  source: /note="Description of Artificial Sequence: Synthetic oligonucleotide"
accuagcuuuucauaaaaccaac

SEQ ID NO: 1473 - RNA, 23 nt, Artificial Sequence
  source: /note="Description of Artificial Sequence: Synthetic oligonucleotide"
auagcaaguugcaaaucuugcuc

SEQ ID NO: 1474 - RNA, 23 nt, Artificial Sequence
  source: /note="Description of Artificial Sequence: Synthetic oligonucleotide"
auagcuuuucauaaaaccaacuc

SEQ ID NO: 1475 - RNA, 23 nt, Artificial Sequence
  source: /note="Description of Artificial Sequence: Synthetic oligonucleotide"
aguugaaggauggauggaagaug

SEQ ID NO: 1476 - RNA, 23 nt, Artificial Sequence
  source: /note="Description of Artificial Sequence: Synthetic oligonucleotide"
auucucuuccaagaaccugaaug

SEQ ID NO: 1477 - RNA, 23 nt, Artificial Sequence
  source: /note="Description of Artificial Sequence: Synthetic oligonucleotide"
acacgacuucgucuuuggaccga

SEQ ID NO: 1478 - RNA, 23 nt, Artificial Sequence
  source: /note="Description of Artificial Sequence: Synthetic oligonucleotide"
agcuuccuagcuuuucauaaaac

SEQ ID NO: 1479 - RNA, 23 nt, Artificial Sequence
  source: /note="Description of Artificial Sequence: Synthetic oligonucleotide"
agaaggguacguugucacucacu

SEQ ID NO: 1480 - RNA, 23 nt, Artificial Sequence
  source: /note="Description of Artificial Sequence: Synthetic oligonucleotide"
auuggugauguccacaugaagaa

SEQ ID NO: 1481 - RNA, 23 nt, Artificial Sequence
  source: /note="Description of Artificial Sequence: Synthetic oligonucleotide"
aguauccaccuuugucuuucauu

SEQ ID NO: 1482 - RNA, 23 nt, Artificial Sequence
  source: /note="Description of Artificial Sequence: Synthetic oligonucleotide"
aaaaacugggaaagguggagagc

SEQ ID NO: 1483 - RNA, 23 nt, Artificial Sequence
  source: /note="Description of Artificial Sequence: Synthetic oligonucleotide"
acuucugaggaugacuucaggcc

SEQ ID NO: 1484 - RNA, 23 nt, Artificial Sequence
  source: /note="Description of Artificial Sequence: Synthetic oligonucleotide"
acuucucuuccaagaaccugaau

SEQ ID NO: 1485 - RNA, 23 nt, Artificial Sequence
  source: /note="Description of Artificial Sequence: Synthetic oligonucleotide"
aauguccacaugaagaaaguucg

SEQ ID NO: 1486 - RNA, 23 nt, Artificial Sequence
  source: /note="Description of Artificial Sequence: Synthetic oligonucleotide"
accuucucuuccaagaaccugaa

SEQ ID NO: 1487 - RNA, 23 nt, Artificial Sequence
  source: /note="Description of Artificial Sequence: Synthetic oligonucleotide"
aggugauguccacaugaagaaag

SEQ ID NO: 1488 - RNA, 23 nt, Artificial Sequence
  source: /note="Description of Artificial Sequence: Synthetic oligonucleotide"
acaaugaaggguacguugucacu

SEQ ID NO: 1489 - RNA, 23 nt, Artificial Sequence
  source: /note="Description of Artificial Sequence: Synthetic oligonucleotide"
agugauguccacaugaagaaagu

SEQ ID NO: 1490 - RNA, 23 nt, Artificial Sequence
  source: /note="Description of Artificial Sequence: Synthetic oligonucleotide"
augauguccacaugaagaaaguu

SEQ ID NO: 1491 - RNA, 23 nt, Artificial Sequence
  source: /note="Description of Artificial Sequence: Synthetic oligonucleotide"
agcaaguugcaaaucuugcucau

SEQ ID NO: 1492 - RNA, 23 nt, Artificial Sequence
  source: /note="Description of Artificial Sequence: Synthetic oligonucleotide"
aaaagucagacaccagaacguuu

SEQ ID NO: 1493 - RNA, 23 nt, Artificial Sequence
  source: /note="Description of Artificial Sequence: Synthetic oligonucleotide"
auggugauguccacaugaagaaa

SEQ ID NO: 1494 - RNA, 23 nt, Artificial Sequence
  source: /note="Description of Artificial Sequence: Synthetic oligonucleotide"
aacuugacuuuagggcagauguc

SEQ ID NO: 1495 - RNA, 23 nt, Artificial Sequence
  source: /note="Description of Artificial Sequence: Synthetic oligonucleotide"
acuuuagcaccucugaaagaauc

SEQ ID NO: 1496 - RNA, 23 nt, Artificial Sequence
  source: /note="Description of Artificial Sequence: Synthetic oligonucleotide"
aguccacaugaagaaaguucgug

SEQ ID NO: 1497 - RNA, 23 nt, Artificial Sequence
  source: /note="Description of Artificial Sequence: Synthetic oligonucleotide"
accaaauauccucgaaggcauau

SEQ ID NO: 1498 - RNA, 23 nt, Artificial Sequence
  source: /note="Description of Artificial Sequence: Synthetic oligonucleotide"
agcaucaaugaaggguacguugu

SEQ ID NO: 1499 - RNA, 23 nt, Artificial Sequence
  source: /note="Description of Artificial Sequence: Synthetic oligonucleotide"
auguccacaugaagaaaguucgu

SEQ ID NO: 1500 - RNA, 23 nt, Artificial Sequence
  source: /note="Description of Artificial Sequence: Synthetic oligonucleotide"
acaccuuuuucaccuaacuaaaa

SEQ ID NO: 1501 - RNA, 23 nt, Artificial Sequence
  source: /note="Description of Artificial Sequence: Synthetic oligonucleotide"
gaacaccuuuuucaccuaacuaa

SEQ ID NO: 1502 - RNA, 23 nt, Artificial Sequence
  source: /note="Description of Artificial Sequence: Synthetic oligonucleotide"
accuuuuucaccuaacuaaaaua

SEQ ID NO: 1503 - RNA, 23 nt, Artificial Sequence
  source: /note="Description of Artificial Sequence: Synthetic oligonucleotide"
gaacuuucuucauguggacauca

SEQ ID NO: 1504 - RNA, 23 nt, Artificial Sequence
  source: /note="Description of Artificial Sequence: Synthetic oligonucleotide"
aacaccuuuuucaccuaacuaaa

SEQ ID NO: 1505 - RNA, 23 nt, Artificial Sequence
  source: /note="Description of Artificial Sequence: Synthetic oligonucleotide"
caccuuuuucaccuaacuaaaau

SEQ ID NO: 1506 - RNA, 23 nt, Artificial Sequence
  source: /note="Description of Artificial Sequence: Synthetic oligonucleotide"
ucuccaccuuucccaguuuuuca

SEQ ID NO: 1507 - RNA, 23 nt, Artificial Sequence
  source: /note="Description of Artificial Sequence: Synthetic oligonucleotide"
agcugaguugguuuuaugaaaag

SEQ ID NO: 1508 - RNA, 23 nt, Artificial Sequence
  source: /note="Description of Artificial Sequence: Synthetic oligonucleotide"
gcaagauuugcaacuugcuaccc

SEQ ID NO: 1509 - RNA, 23 nt, Artificial Sequence
  source: /note="Description of Artificial Sequence: Synthetic oligonucleotide"
caugagcaagauuugcaacuugc

SEQ ID NO: 1510 - RNA, 23 nt, Artificial Sequence
  source: /note="Description of Artificial Sequence: Synthetic oligonucleotide"
gaaaacguucuggugucugacuu

SEQ ID NO: 1511 - RNA, 23 nt, Artificial Sequence
  source: /note="Description of Artificial Sequence: Synthetic oligonucleotide"
agaacaccuuuuucaccuaacua

SEQ ID NO: 1512 - RNA, 23 nt, Artificial Sequence
  source: /note="Description of Artificial Sequence: Synthetic oligonucleotide"
cuccaccuuucccaguuuuucac

SEQ ID NO: 1513 - RNA, 23 nt, Artificial Sequence
  source: /note="Description of Artificial Sequence: Synthetic oligonucleotide"
ugcagguccucucagaucuugug

SEQ ID NO: 1514 - RNA, 23 nt, Artificial Sequence
  source: /note="Description of Artificial Sequence: Synthetic oligonucleotide"
uccaccuuucccaguuuuucacu

SEQ ID NO: 1515 - RNA, 23 nt, Artificial Sequence
  source: /note="Description of Artificial Sequence: Synthetic oligonucleotide"
ugaaagacaaagguggauacaug

SEQ ID NO: 1516 - RNA, 23 nt, Artificial Sequence
  source: /note="Description of Artificial Sequence: Synthetic oligonucleotide"
ccuuuuucaccuaacuaaaauaa

SEQ ID NO: 1517 - RNA, 23 nt, Artificial Sequence
  source: /note="Description of Artificial Sequence: Synthetic oligonucleotide"
acaugagcaagauuugcaacuug

SEQ ID NO: 1518 - RNA, 23 nt, Artificial Sequence
  source: /note="Description of Artificial Sequence: Synthetic oligonucleotide"
agauuugcaacuugcuacccauu

SEQ ID NO: 1519 - RNA, 23 nt, Artificial Sequence
  source: /note="Description of Artificial Sequence: Synthetic oligonucleotide"
gugacaacguacccuucauugau

SEQ ID NO: 1520 - RNA, 23 nt, Artificial Sequence
  source: /note="Description of Artificial Sequence: Synthetic oligonucleotide"
acuugcuacccauuaggauaaug

SEQ ID NO: 1521 - RNA, 23 nt, Artificial Sequence
  source: /note="Description of Artificial Sequence: Synthetic oligonucleotide"
uaugccuucgaggauauuuggau

SEQ ID NO: 1522 - RNA, 23 nt, Artificial Sequence
  source: /note="Description of Artificial Sequence: Synthetic oligonucleotide"
gagcugaguugguuuuaugaaaa

SEQ ID NO: 1523 - RNA, 23 nt, Artificial Sequence
  source: /note="Description of Artificial Sequence: Synthetic oligonucleotide"
auuugcaacuugcuacccauuag

SEQ ID NO: 1524 - RNA, 23 nt, Artificial Sequence
  source: /note="Description of Artificial Sequence: Synthetic oligonucleotide"
ggcucuccaccuuucccaguuuu

SEQ ID NO: 1525 - RNA, 23 nt, Artificial Sequence
  source: /note="Description of Artificial Sequence: Synthetic oligonucleotide"
aguugguuuuaugaaaagcuagg

SEQ ID NO: 1526 - RNA, 23 nt, Artificial Sequence
  source: /note="Description of Artificial Sequence: Synthetic oligonucleotide"
uacaugagcaagauuugcaacuu

SEQ ID NO: 1527 - RNA, 23 nt, Artificial Sequence
  source: /note="Description of Artificial Sequence: Synthetic oligonucleotide"
ccucugagcugaguugguuuuau

SEQ ID NO: 1528 - RNA, 23 nt, Artificial Sequence
  source: /note="Description of Artificial Sequence: Synthetic oligonucleotide"
acguacccuucauugaugccaaa

SEQ ID NO: 1529 - RNA, 23 nt, Artificial Sequence
  source: /note="Description of Artificial Sequence: Synthetic oligonucleotide"
agguccagccugaacuucuucuu

SEQ ID NO: 1530 - RNA, 23 nt, Artificial Sequence
  source: /note="Description of Artificial Sequence: Synthetic oligonucleotide"
aacuugcuacccauuaggauaau

SEQ ID NO: 1531 - RNA, 23 nt, Artificial Sequence
  source: /note="Description of Artificial Sequence: Synthetic oligonucleotide"
gguggauacaugagcaagauuug

SEQ ID NO: 1532 - RNA, 23 nt, Artificial Sequence
  source: /note="Description of Artificial Sequence: Synthetic oligonucleotide"
gcccuauuaauggucagacuguu

SEQ ID NO: 1533 - RNA, 23 nt, Artificial Sequence
  source: /note="Description of Artificial Sequence: Synthetic oligonucleotide"
ucugagcugaguugguuuuauga

SEQ ID NO: 1534 - RNA, 23 nt, Artificial Sequence
  source: /note="Description of Artificial Sequence: Synthetic oligonucleotide"
gcaucuuccauccauccuucaac

SEQ ID NO: 1535 - RNA, 23 nt, Artificial Sequence
  source: /note="Description of Artificial Sequence: Synthetic oligonucleotide"
cucugagcugaguugguuuuaug

SEQ ID NO: 1536 - RNA, 23 nt, Artificial Sequence
  source: /note="Description of Artificial Sequence: Synthetic oligonucleotide"
agcaagauuugcaacuugcuacc

SEQ ID NO: 1537 - RNA, 23 nt, Artificial Sequence
  source: /note="Description of Artificial Sequence: Synthetic oligonucleotide"
auacaugagcaagauuugcaacu

SEQ ID NO: 1538 - RNA, 23 nt, Artificial Sequence
  source: /note="Description of Artificial Sequence: Synthetic oligonucleotide"
cccuauuaauggucagacuguuc

SEQ ID NO: 1539 - RNA, 23 nt, Artificial Sequence
  source: /note="Description of Artificial Sequence: Synthetic oligonucleotide"
acagggaaccucuaccuucucuc

SEQ ID NO: 1540 - RNA, 23 nt, Artificial Sequence
  source: /note="Description of Artificial Sequence: Synthetic oligonucleotide"
cuauuaauggucagacuguucca

SEQ ID NO: 1541 - RNA, 23 nt, Artificial Sequence
  source: /note="Description of Artificial Sequence: Synthetic oligonucleotide"
gacaacguacccuucauugaugc

SEQ ID NO: 1542 - RNA, 23 nt, Artificial Sequence
  source: /note="Description of Artificial Sequence: Synthetic oligonucleotide"
gguuuuaugaaaagcuaggaagc

SEQ ID NO: 1543 - RNA, 23 nt, Artificial Sequence
  source: /note="Description of Artificial Sequence: Synthetic oligonucleotide"
gauaugccuucgaggauauuugg

SEQ ID NO: 1544 - RNA, 23 nt, Artificial Sequence
  source: /note="Description of Artificial Sequence: Synthetic oligonucleotide"
cucuccaccuuucccaguuuuuc

SEQ ID NO: 1545 - RNA, 23 nt, Artificial Sequence
  source: /note="Description of Artificial Sequence: Synthetic oligonucleotide"
ccaccuuucccaguuuuucacua

SEQ ID NO: 1546 - RNA, 23 nt, Artificial Sequence
  source: /note="Description of Artificial Sequence: Synthetic oligonucleotide"
ugagcaagauuugcaacuugcua

SEQ ID NO: 1547 - RNA, 23 nt, Artificial Sequence
  source: /note="Description of Artificial Sequence: Synthetic oligonucleotide"
gagugacaacguacccuucauug

SEQ ID NO: 1548 - RNA, 23 nt, Artificial Sequence
  source: /note="Description of Artificial Sequence: Synthetic oligonucleotide"
ugaguugguuuuaugaaaagcua

SEQ ID NO: 1549 - RNA, 23 nt, Artificial Sequence
  source: /note="Description of Artificial Sequence: Synthetic oligonucleotide"
aacguucuggugucugacuuucg

SEQ ID NO: 1550 - RNA, 23 nt, Artificial Sequence
  source: /note="Description of Artificial Sequence: Synthetic oligonucleotide"
aaucugccauugcgauuguccag

SEQ ID NO: 1551 - RNA, 23 nt, Artificial Sequence
  source: /note="Description of Artificial Sequence: Synthetic oligonucleotide"
agcaugagguucuuagaaugaca

SEQ ID NO: 1552 - RNA, 23 nt, Artificial Sequence
  source: /note="Description of Artificial Sequence: Synthetic oligonucleotide"
gcugaguugguuuuaugaaaagc

SEQ ID NO: 1553 - RNA, 23 nt, Artificial Sequence
  source: /note="Description of Artificial Sequence: Synthetic oligonucleotide"
uucgguccaaagacgaagucgug

SEQ ID NO: 1554 - RNA, 23 nt, Artificial Sequence
  source: /note="Description of Artificial Sequence: Synthetic oligonucleotide"
ugacaacguacccuucauugaug

SEQ ID NO: 1555 - RNA, 23 nt, Artificial Sequence
  source: /note="Description of Artificial Sequence: Synthetic oligonucleotide"
ugagcugaguugguuuuaugaaa

SEQ ID NO: 1556 - RNA, 23 nt, Artificial Sequence
  source: /note="Description of Artificial Sequence: Synthetic oligonucleotide"
uaugugaaucagugagauguuag

SEQ ID NO: 1557 - RNA, 23 nt, Artificial Sequence
  source: /note="Description of Artificial Sequence: Synthetic oligonucleotide"
gcauucagguucuuggaagagaa

SEQ ID NO: 1558 - RNA, 23 nt, Artificial Sequence
  source: /note="Description of Artificial Sequence: Synthetic oligonucleotide"
aaaacguucuggugucugacuuu

SEQ ID NO: 1559 - RNA, 23 nt, Artificial Sequence
  source: /note="Description of Artificial Sequence: Synthetic oligonucleotide"
cugagcugaguugguuuuaugaa

SEQ ID NO: 1560 - RNA, 23 nt, Artificial Sequence
  source: /note="Description of Artificial Sequence: Synthetic oligonucleotide"
gaaagacaaagguggauacauga

SEQ ID NO: 1561 - RNA, 23 nt, Artificial Sequence
  source: /note="Description of Artificial Sequence: Synthetic oligonucleotide"
cugaguugguuuuaugaaaagcu

SEQ ID NO: 1562 - RNA, 23 nt, Artificial Sequence
  source: /note="Description of Artificial Sequence: Synthetic oligonucleotide"
guugguuuuaugaaaagcuagga

SEQ ID NO: 1563 - RNA, 23 nt, Artificial Sequence
  source: /note="Description of Artificial Sequence: Synthetic oligonucleotide"
gagcaagauuugcaacuugcuac

SEQ ID NO: 1564 - RNA, 23 nt, Artificial Sequence
  source: /note="Description of Artificial Sequence: Synthetic oligonucleotide"
gaguugguuuuaugaaaagcuag

SEQ ID NO: 1565 - RNA, 23 nt, Artificial Sequence
  source: /note="Description of Artificial Sequence: Synthetic oligonucleotide"
caucuuccauccauccuucaacu

SEQ ID NO: 1566 - RNA, 23 nt, Artificial Sequence
  source: /note="Description of Artificial Sequence: Synthetic oligonucleotide"
cauucagguucuuggaagagaag

SEQ ID NO: 1567 - RNA, 23 nt, Artificial Sequence
  source: /note="Description of Artificial Sequence: Synthetic oligonucleotide"
ucgguccaaagacgaagucgugg

SEQ ID NO: 1568 - RNA, 23 nt, Artificial Sequence
  source: /note="Description of Artificial Sequence: Synthetic oligonucleotide"
guuuuaugaaaagcuaggaagca

SEQ ID NO: 1569 - RNA, 23 nt, Artificial Sequence
  source: /note="Description of Artificial Sequence: Synthetic oligonucleotide"
agugagugacaacguacccuuca

SEQ ID NO: 1570 - RNA, 23 nt, Artificial Sequence
  source: /note="Description of Artificial Sequence: Synthetic oligonucleotide"
uucuucauguggacaucaccaag

SEQ ID NO: 1571 - RNA, 23 nt, Artificial Sequence
  source: /note="Description of Artificial Sequence: Synthetic oligonucleotide"
aaugaaagacaaagguggauaca

SEQ ID NO: 1572 - RNA, 23 nt, Artificial Sequence
  source: /note="Description of Artificial Sequence: Synthetic oligonucleotide"
gcucuccaccuuucccaguuuuu

SEQ ID NO: 1573 - RNA, 23 nt, Artificial Sequence
  source: /note="Description of Artificial Sequence: Synthetic oligonucleotide"
ggccugaagucauccucagaagg

SEQ ID NO: 1574 - RNA, 23 nt, Artificial Sequence
  source: /note="Description of Artificial Sequence: Synthetic oligonucleotide"
auucagguucuuggaagagaagg

SEQ ID NO: 1575 - RNA, 23 nt, Artificial Sequence
  source: /note="Description of Artificial Sequence: Synthetic oligonucleotide"
cgaacuuucuucauguggacauc

SEQ ID NO: 1576 - RNA, 23 nt, Artificial Sequence
  source: /note="Description of Artificial Sequence: Synthetic oligonucleotide"
uucagguucuuggaagagaaggg

SEQ ID NO: 1577 - RNA, 23 nt, Artificial Sequence
  source: /note="Description of Artificial Sequence: Synthetic oligonucleotide"
cuuucuucauguggacaucacca

SEQ ID NO: 1578 - RNA, 23 nt, Artificial Sequence
  source: /note="Description of Artificial Sequence: Synthetic oligonucleotide"
agugacaacguacccuucauuga

SEQ ID NO: 1579 - RNA, 23 nt, Artificial Sequence
  source: /note="Description of Artificial Sequence: Synthetic oligonucleotide"
acuuucuucauguggacaucacc

SEQ ID NO: 1580 - RNA, 23 nt, Artificial Sequence
  source: /note="Description of Artificial Sequence: Synthetic oligonucleotide"
aacuuucuucauguggacaucac

SEQ ID NO: 1581 - RNA, 23 nt, Artificial Sequence
  source: /note="Description of Artificial Sequence: Synthetic oligonucleotide"
augagcaagauuugcaacuugcu

SEQ ID NO: 1582 - RNA, 23 nt, Artificial Sequence
  source: /note="Description of Artificial Sequence: Synthetic oligonucleotide"
aaacguucuggugucugacuuuc

SEQ ID NO: 1583 - RNA, 23 nt, Artificial Sequence
  source: /note="Description of Artificial Sequence: Synthetic oligonucleotide"
uuucuucauguggacaucaccaa

SEQ ID NO: 1584 - RNA, 23 nt, Artificial Sequence
  source: /note="Description of Artificial Sequence: Synthetic oligonucleotide"
gacaucugcccuaaagucaaguc

SEQ ID NO: 1585 - RNA, 23 nt, Artificial Sequence
  source: /note="Description of Artificial Sequence: Synthetic oligonucleotide"
gauucuuucagaggugcuaaagu

SEQ ID NO: 1586 - RNA, 23 nt, Artificial Sequence
  source: /note="Description of Artificial Sequence: Synthetic oligonucleotide"
cacgaacuuucuucauguggaca

SEQ ID NO: 1587 - RNA, 23 nt, Artificial Sequence
  source: /note="Description of Artificial Sequence: Synthetic oligonucleotide"
auaugccuucgaggauauuugga

SEQ ID NO: 1588 - RNA, 23 nt, Artificial Sequence
  source: /note="Description of Artificial Sequence: Synthetic oligonucleotide"
acaacguacccuucauugaugcc

SEQ ID NO: 1589 - RNA, 23 nt, Artificial Sequence
  source: /note="Description of Artificial Sequence: Synthetic oligonucleotide"
acgaacuuucuucauguggacau

SEQ ID NO: 1590 - RNA, 19 nt, Artificial Sequence
  source: /note="Description of Artificial Sequence: Synthetic oligonucleotide"
acagggaaccucuaccuuu

SEQ ID NO: 1591 - RNA, 19 nt, Artificial Sequence
  source: /note="Description of Artificial Sequence: Synthetic oligonucleotide"
acagggaaccucuaccuuu

SEQ ID NO: 1592 - RNA, 19 nt, Artificial Sequence
  source: /note="Description of Artificial Sequence: Synthetic oligonucleotide"
acagggaaccucuaccuuu

SEQ ID NO: 1593 - RNA, 19 nt, Artificial Sequence
  source: /note="Description of Artificial Sequence: Synthetic oligonucleotide"
ccauugcgauuguccagau

SEQ ID NO: 1594 - RNA, 19 nt, Artificial Sequence
  source: /note="Description of Artificial Sequence: Synthetic oligonucleotide"
ccauugcgauuguccagau

SEQ ID NO: 1595 - RNA, 19 nt, Artificial Sequence
  source: /note="Description of Artificial Sequence: Synthetic oligonucleotide"
ccauugcgauuguccagau

SEQ ID NO: 1596 - RNA, 19 nt, Artificial Sequence
  source: /note="Description of Artificial Sequence: Synthetic oligonucleotide"
cgaagucguggaugccuuu

SEQ ID NO: 1597 - RNA, 19 nt, Artificial Sequence
  source: /note="Description of Artificial Sequence: Synthetic oligonucleotide"
cgaagucguggaugccuuu

SEQ ID NO: 1598 - RNA, 19 nt, Artificial Sequence
  source: /note="Description of Artificial Sequence: Synthetic oligonucleotide"
cgaagucguggaugccuuu

SEQ ID NO: 1599 - RNA, 19 nt, Artificial Sequence
  source: /note="Description of Artificial Sequence: Synthetic oligonucleotide"
cuuuuucaccuaacuaaau

SEQ ID NO: 1600 - RNA, 19 nt, Artificial Sequence
  source: /note="Description of Artificial Sequence: Synthetic oligonucleotide"
cuuuuucaccuaacuaaau

SEQ ID NO: 1601 - RNA, 19 nt, Artificial Sequence
  source: /note="Description of Artificial Sequence: Synthetic oligonucleotide"
cuuuuucaccuaacuaaau

SEQ ID NO: 1602 - RNA, 19 nt, Artificial Sequence
  source: /note="Description of Artificial Sequence: Synthetic oligonucleotide"
gaagucguggaugccuugu

SEQ ID NO: 1603 - RNA, 19 nt, Artificial Sequence
  source: /note="Description of Artificial Sequence: Synthetic oligonucleotide"
gaagucguggaugccuugu

SEQ ID NO: 1604 - RNA, 19 nt, Artificial Sequence
  source: /note="Description of Artificial Sequence: Synthetic oligonucleotide"
gaagucguggaugccuugu

SEQ ID NO: 1605 - RNA, 19 nt, Artificial Sequence
  source: /note="Description of Artificial Sequence: Synthetic oligonucleotide"
gagugagugacaacguacu

SEQ ID NO: 1606 - RNA, 19 nt, Artificial Sequence
  source: /note="Description of Artificial Sequence: Synthetic oligonucleotide"
gagugagugacaacguacu

SEQ ID NO: 1607 - RNA, 19 nt, Artificial Sequence
  source: /note="Description of Artificial Sequence: Synthetic oligonucleotide"
gagugagugacaacguacu

SEQ ID NO: 1608 - RNA, 19 nt, Artificial Sequence
  source: /note="Description of Artificial Sequence: Synthetic oligonucleotide"
gauaugccuucgaggauau

SEQ ID NO: 1609 - RNA, 19 nt, Artificial Sequence
  source: /note="Description of Artificial Sequence: Synthetic oligonucleotide"
gauaugccuucgaggauau

SEQ ID NO: 1610 - RNA, 19 nt, Artificial Sequence
  source: /note="Description of Artificial Sequence: Synthetic oligonucleotide"
gauaugccuucgaggauau

SEQ ID NO: 1611 - RNA, 19 nt, Artificial Sequence
  source: /note="Description of Artificial Sequence: Synthetic oligonucleotide"
ggagagauaugccuucgau

SEQ ID NO: 1612 - RNA, 19 nt, Artificial Sequence
  source: /note="Description of Artificial Sequence: Synthetic oligonucleotide"
ggagagauaugccuucgau

SEQ ID NO: 1613 - RNA, 19 nt, Artificial Sequence
  source: /note="Description of Artificial Sequence: Synthetic oligonucleotide"
ggagagauaugccuucgau

SEQ ID NO: 1614 - RNA, 19 nt, Artificial Sequence
  source: /note="Description of Artificial Sequence: Synthetic oligonucleotide"
ggauaaugucuuauguaau

SEQ ID NO: 1615 - RNA, 19 nt, Artificial Sequence
  source: /note="Description of Artificial Sequence: Synthetic oligonucleotide"
ggauaaugucuuauguaau

SEQ ID NO: 1616 - RNA, 19 nt, Artificial Sequence
  source: /note="Description of Artificial Sequence: Synthetic oligonucleotide"
ggauaaugucuuauguaau

SEQ ID NO: 1617 - RNA, 19 nt, Artificial Sequence
  source: /note="Description of Artificial Sequence: Synthetic oligonucleotide"
gguuuuaugaaaagcuagu

SEQ ID NO: 1618 - RNA, 19 nt, Artificial Sequence
  source: /note="Description of Artificial Sequence: Synthetic oligonucleotide"
gguuuuaugaaaagcuagu

SEQ ID NO: 1619 - RNA, 19 nt, Artificial Sequence
  source: /note="Description of Artificial Sequence: Synthetic oligonucleotide"
gguuuuaugaaaagcuagu

SEQ ID NO: 1620 - RNA, 19 nt, Artificial Sequence
  source: /note="Description of Artificial Sequence: Synthetic oligonucleotide"
ugcuacccauuaggauaau

SEQ ID NO: 1621 - RNA, 19 nt, Artificial Sequence
  source: /note="Description of Artificial Sequence: Synthetic oligonucleotide"
ugcuacccauuaggauaau

SEQ ID NO: 1622 - RNA, 19 nt, Artificial Sequence
  source: /note="Description of Artificial Sequence: Synthetic oligonucleotide"
ugcuacccauuaggauaau

SEQ ID NO: 1623 - RNA, 19 nt, Artificial Sequence
  source: /note="Description of Artificial Sequence: Synthetic oligonucleotide"
uggugacauggcuuccagu

SEQ ID NO: 1624 - RNA, 19 nt, Artificial Sequence
  source: /note="Description of Artificial Sequence: Synthetic oligonucleotide"
uggugacauggcuuccagu

SEQ ID NO: 1625 - RNA, 19 nt, Artificial Sequence
  source: /note="Description of Artificial Sequence: Synthetic oligonucleotide"
uggugacauggcuuccagu

SEQ ID NO: 1626 - RNA, 19 nt, Artificial Sequence
  source: /note="Description of Artificial Sequence: Synthetic oligonucleotide"
aaagguagagguucccugu

SEQ ID NO: 1627 - RNA, 19 nt, Artificial Sequence
  source: /note="Description of Artificial Sequence: Synthetic oligonucleotide"
aaagguagagguucccugu

SEQ ID NO: 1628 - RNA, 19 nt, Artificial Sequence
  source: /note="Description of Artificial Sequence: Synthetic oligonucleotide"
aaagguagagguucccugu

SEQ ID NO: 1629 - RNA, 19 nt, Artificial Sequence
  source: /note="Description of Artificial Sequence: Synthetic oligonucleotide"
aucuggacaaucgcaaugg

SEQ ID NO: 1630 - RNA, 19 nt, Artificial Sequence
  source: /note="Description of Artificial Sequence: Synthetic oligonucleotide"
aucuggacaaucgcaaugg

SEQ ID NO: 1631 - RNA, 19 nt, Artificial Sequence
  source: /note="Description of Artificial Sequence: Synthetic oligonucleotide"
aucuggacaaucgcaaugg

SEQ ID NO: 1632 - RNA, 19 nt, Artificial Sequence
  source: /note="Description of Artificial Sequence: Synthetic oligonucleotide"
aaaggcauccacgacuucg

SEQ ID NO: 1633 - RNA, 19 nt, Artificial Sequence
  source: /note="Description of Artificial Sequence: Synthetic oligonucleotide"
aaaggcauccacgacuucg

SEQ ID NO: 1634 - RNA, 19 nt, Artificial Sequence
  source: /note="Description of Artificial Sequence: Synthetic oligonucleotide"
aaaggcauccacgacuucg

SEQ ID NO: 1635 - RNA, 19 nt, Artificial Sequence
  source: /note="Description of Artificial Sequence: Synthetic oligonucleotide"
auuuaguuaggugaaaaag

SEQ ID NO: 1636 - RNA, 19 nt, Artificial Sequence
  source: /note="Description of Artificial Sequence: Synthetic oligonucleotide"
auuuaguuaggugaaaaag

SEQ ID NO: 1637 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
auuuagtuaggugaaaaag

SEQ ID NO: 1638 - RNA, 19 nt, Artificial Sequence
  source: /note="Description of Artificial Sequence: Synthetic oligonucleotide"
acaaggcauccacgacuuc

SEQ ID NO: 1639 - RNA, 19 nt, Artificial Sequence
  source: /note="Description of Artificial Sequence: Synthetic oligonucleotide"
acaaggcauccacgacuuc

SEQ ID NO: 1640 - RNA, 19 nt, Artificial Sequence
  source: /note="Description of Artificial Sequence: Synthetic oligonucleotide"
acaaggcauccacgacuuc

SEQ ID NO: 1641 - RNA, 19 nt, Artificial Sequence
  source: /note="Description of Artificial Sequence: Synthetic oligonucleotide"
aguacguugucacucacuc

SEQ ID NO: 1642 - RNA, 19 nt, Artificial Sequence
  source: /note="Description of Artificial Sequence: Synthetic oligonucleotide"
aguacguugucacucacuc

SEQ ID NO: 1643 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
aguacgtugucacucacuc

SEQ ID NO: 1644 - RNA, 19 nt, Artificial Sequence
  source: /note="Description of Artificial Sequence: Synthetic oligonucleotide"
auauccucgaaggcauauc

SEQ ID NO: 1645 - RNA, 19 nt, Artificial Sequence
  source: /note="Description of Artificial Sequence: Synthetic oligonucleotide"
auauccucgaaggcauauc

SEQ ID NO: 1646 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
auaucctcgaaggcauauc

SEQ ID NO: 1647 - RNA, 19 nt, Artificial Sequence
  source: /note="Description of Artificial Sequence: Synthetic oligonucleotide"
aucgaaggcauaucucucc

SEQ ID NO: 1648 - RNA, 19 nt, Artificial Sequence
  source: /note="Description of Artificial Sequence: Synthetic oligonucleotide"
aucgaaggcauaucucucc

SEQ ID NO: 1649 - RNA, 19 nt, Artificial Sequence
  source: /note="Description of Artificial Sequence: Synthetic oligonucleotide"
aucgaaggcauaucucucc

SEQ ID NO: 1650 - RNA, 19 nt, Artificial Sequence
  source: /note="Description of Artificial Sequence: Synthetic oligonucleotide"
auuacauaagacauuaucc

SEQ ID NO: 1651 - RNA, 19 nt, Artificial Sequence
  source: /note="Description of Artificial Sequence: Synthetic oligonucleotide"
auuacauaagacauuaucc

SEQ ID NO: 1652 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuaucc

SEQ ID NO: 1653 - RNA, 19 nt, Artificial Sequence
  source: /note="Description of Artificial Sequence: Synthetic oligonucleotide"
acuagcuuuucauaaaacc

SEQ ID NO: 1654 - RNA, 19 nt, Artificial Sequence
  source: /note="Description of Artificial Sequence: Synthetic oligonucleotide"
acuagcuuuucauaaaacc

SEQ ID NO: 1655 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
acuagctuuucauaaaacc

SEQ ID NO: 1656 - RNA, 19 nt, Artificial Sequence
  source: /note="Description of Artificial Sequence: Synthetic oligonucleotide"
auuauccuaauggguagca

SEQ ID NO: 1657 - RNA, 19 nt, Artificial Sequence
  source: /note="Description of Artificial Sequence: Synthetic oligonucleotide"
auuauccuaauggguagca

SEQ ID NO: 1658 - RNA, 19 nt, Artificial Sequence
  source: /note="Description of Artificial Sequence: Synthetic oligonucleotide"
auuauccuaauggguagca

SEQ ID NO: 1659 - RNA, 19 nt, Artificial Sequence
  source: /note="Description of Artificial Sequence: Synthetic oligonucleotide"
acuggaagccaugucacca

SEQ ID NO: 1660 - RNA, 19 nt, Artificial Sequence
  source: /note="Description of Artificial Sequence: Synthetic oligonucleotide"
acuggaagccaugucacca

SEQ ID NO: 1661 - RNA, 19 nt, Artificial Sequence
  source: /note="Description of Artificial Sequence: Synthetic oligonucleotide"
acuggaagccaugucacca

SEQ ID NO: 1662 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagggaaccucuaccuuutt

SEQ ID NO: 1663 - RNA, 19 nt, Artificial Sequence
  source: /note="Description of Artificial Sequence: Synthetic oligonucleotide"
acagggaaccucuaccuuu

SEQ ID NO: 1664 - RNA, 19 nt, Artificial Sequence
  source: /note="Description of Artificial Sequence: Synthetic oligonucleotide"
acagggaaccucuaccuuu

SEQ ID NO: 1665 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauugcgauuguccagautt

SEQ ID NO: 1666 - RNA, 19 nt, Artificial Sequence
  source: /note="Description of Artificial Sequence: Synthetic oligonucleotide"
ccauugcgauuguccagau

SEQ ID NO: 1667 - RNA, 19 nt, Artificial Sequence
  source: /note="Description of Artificial Sequence: Synthetic oligonucleotide"
ccauugcgauuguccagau

SEQ ID NO: 1668 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaagucguggaugccuuutt

SEQ ID NO: 1669 - RNA, 19 nt, Artificial Sequence
  source: /note="Description of Artificial Sequence: Synthetic oligonucleotide"
cgaagucguggaugccuuu

SEQ ID NO: 1670 - RNA, 19 nt, Artificial Sequence
  source: /note="Description of Artificial Sequence: Synthetic oligonucleotide"
cgaagucguggaugccuuu

SEQ ID NO: 1671 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuuucaccuaacuaaautt

SEQ ID NO: 1672 - RNA, 19 nt, Artificial Sequence
  source: /note="Description of Artificial Sequence: Synthetic oligonucleotide"
cuuuuucaccuaacuaaau

SEQ ID NO: 1673 - RNA, 19 nt, Artificial Sequence
  source: /note="Description of Artificial Sequence: Synthetic oligonucleotide"
cuuuuucaccuaacuaaau

SEQ ID NO: 1674 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagucguggaugccuugutt

SEQ ID NO: 1675 - RNA, 19 nt, Artificial Sequence
  source: /note="Description of Artificial Sequence: Synthetic oligonucleotide"
gaagucguggaugccuugu

SEQ ID NO: 1676 - RNA, 19 nt, Artificial Sequence
  source: /note="Description of Artificial Sequence: Synthetic oligonucleotide"
gaagucguggaugccuugu

SEQ ID NO: 1677 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagugagugacaacguacutt

SEQ ID NO: 1678 - RNA, 19 nt, Artificial Sequence
  source: /note="Description of Artificial Sequence: Synthetic oligonucleotide"
gagugagugacaacguacu

SEQ ID NO: 1679 - RNA, 19 nt, Artificial Sequence
  source: /note="Description of Artificial Sequence: Synthetic oligonucleotide"
gagugagugacaacguacu

SEQ ID NO: 1680 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauaugccuucgaggauautt

SEQ ID NO: 1681 - RNA, 19 nt, Artificial Sequence
  source: /note="Description of Artificial Sequence: Synthetic oligonucleotide"
gauaugccuucgaggauau

SEQ ID NO: 1682 - RNA, 19 nt, Artificial Sequence
  source: /note="Description of Artificial Sequence: Synthetic oligonucleotide"
gauaugccuucgaggauau

SEQ ID NO: 1683 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagagauaugccuucgautt

SEQ ID NO: 1684 - RNA, 19 nt, Artificial Sequence
  source: /note="Description of Artificial Sequence: Synthetic oligonucleotide"
ggagagauaugccuucgau

SEQ ID NO: 1685 - RNA, 19 nt, Artificial Sequence
  source: /note="Description of Artificial Sequence: Synthetic oligonucleotide"
ggagagauaugccuucgau

SEQ ID NO: 1686 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggauaaugucuuauguaautt

SEQ ID NO: 1687 - RNA, 19 nt, Artificial Sequence
  source: /note="Description of Artificial Sequence: Synthetic oligonucleotide"
ggauaaugucuuauguaau

SEQ ID NO: 1688 - RNA, 19 nt, Artificial Sequence
  source: /note="Description of Artificial Sequence: Synthetic oligonucleotide"
ggauaaugucuuauguaau

SEQ ID NO: 1689 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuuuaugaaaagcuagutt

SEQ ID NO: 1690 - RNA, 19 nt, Artificial Sequence
  source: /note="Description of Artificial Sequence: Synthetic oligonucleotide"
gguuuuaugaaaagcuagu

SEQ ID NO: 1691 - RNA, 19 nt, Artificial Sequence
  source: /note="Description of Artificial Sequence: Synthetic oligonucleotide"
gguuuuaugaaaagcuagu

SEQ ID NO: 1692 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuacccauuaggauaautt

SEQ ID NO: 1693 - RNA, 19 nt, Artificial Sequence
  source: /note="Description of Artificial Sequence: Synthetic oligonucleotide"
ugcuacccauuaggauaau

SEQ ID NO: 1694 - RNA, 19 nt, Artificial Sequence
  source: /note="Description of Artificial Sequence: Synthetic oligonucleotide"
ugcuacccauuaggauaau

SEQ ID NO: 1695 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugacauggcuuccagutt

SEQ ID NO: 1696 - RNA, 19 nt, Artificial Sequence
  source: /note="Description of Artificial Sequence: Synthetic oligonucleotide"
uggugacauggcuuccagu

SEQ ID NO: 1697 - RNA, 19 nt, Artificial Sequence
  source: /note="Description of Artificial Sequence: Synthetic oligonucleotide"
uggugacauggcuuccagu

SEQ ID NO: 1698 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagguagagguucccugutt

SEQ ID NO: 1699 - RNA, 19 nt, Artificial Sequence
  source: /note="Description of Artificial Sequence: Synthetic oligonucleotide"
aaagguagagguucccugu

SEQ ID NO: 1700 - RNA, 19 nt, Artificial Sequence
  source: /note="Description of Artificial Sequence: Synthetic oligonucleotide"
aaagguagagguucccugu

SEQ ID NO: 1701 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuggacaaucgcaauggtt

SEQ ID NO: 1702 - RNA, 19 nt, Artificial Sequence
  source: /note="Description of Artificial Sequence: Synthetic oligonucleotide"
aucuggacaaucgcaaugg

SEQ ID NO: 1703 - RNA, 19 nt, Artificial Sequence
  source: /note="Description of Artificial Sequence: Synthetic oligonucleotide"
aucuggacaaucgcaaugg

SEQ ID NO: 1704 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaggcauccacgacuucgtt

SEQ ID NO: 1705 - RNA, 19 nt, Artificial Sequence
  source: /note="Description of Artificial Sequence: Synthetic oligonucleotide"
aaaggcauccacgacuucg

SEQ ID NO: 1706 - RNA, 19 nt, Artificial Sequence
  source: /note="Description of Artificial Sequence: Synthetic oligonucleotide"
aaaggcauccacgacuucg

SEQ ID NO: 1707 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuaguuaggugaaaaagtt

SEQ ID NO: 1708 - RNA, 19 nt, Artificial Sequence
  source: /note="Description of Artificial Sequence: Synthetic oligonucleotide"
auuuaguuaggugaaaaag

SEQ ID NO: 1709 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
auuuagtuaggugaaaaag

SEQ ID NO: 1710 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaggcauccacgacuuctt

SEQ ID NO: 1711 - RNA, 19 nt, Artificial Sequence
  source: /note="Description of Artificial Sequence: Synthetic oligonucleotide"
acaaggcauccacgacuuc

SEQ ID NO: 1712 - RNA, 19 nt, Artificial Sequence
  source: /note="Description of Artificial Sequence: Synthetic oligonucleotide"
acaaggcauccacgacuuc

SEQ ID NO: 1713 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguacguugucacucacuctt

SEQ ID NO: 1714 - RNA, 19 nt, Artificial Sequence
  source: /note="Description of Artificial Sequence: Synthetic oligonucleotide"
aguacguugucacucacuc

SEQ ID NO: 1715 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
aguacgtugucacucacuc

SEQ ID NO: 1716 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauccucgaaggcauauctt

SEQ ID NO: 1717 - RNA, 19 nt, Artificial Sequence
  source: /note="Description of Artificial Sequence: Synthetic oligonucleotide"
auauccucgaaggcauauc

SEQ ID NO: 1718 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
auaucctcgaaggcauauc

SEQ ID NO: 1719 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgaaggcauaucucucctt

SEQ ID NO: 1720 - RNA, 19 nt, Artificial Sequence
  source: /note="Description of Artificial Sequence: Synthetic oligonucleotide"
aucgaaggcauaucucucc

SEQ ID NO: 1721 - RNA, 19 nt, Artificial Sequence
  source: /note="Description of Artificial Sequence: Synthetic oligonucleotide"
aucgaaggcauaucucucc

SEQ ID NO: 1722 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuacauaagacauuaucctt

SEQ ID NO: 1723 - RNA, 19 nt, Artificial Sequence
  source: /note="Description of Artificial Sequence: Synthetic oligonucleotide"
auuacauaagacauuaucc

SEQ ID NO: 1724 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuaucc

SEQ ID NO: 1725 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuagcuuuucauaaaacctt

SEQ ID NO: 1726 - RNA, 19 nt, Artificial Sequence
  source: /note="Description of Artificial Sequence: Synthetic oligonucleotide"
acuagcuuuucauaaaacc

SEQ ID NO: 1727 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
acuagctuuucauaaaacc

SEQ ID NO: 1728 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuauccuaauggguagcatt

SEQ ID NO: 1729 - RNA, 19 nt, Artificial Sequence
  source: /note="Description of Artificial Sequence: Synthetic oligonucleotide"
auuauccuaauggguagca

SEQ ID NO: 1730 - RNA, 19 nt, Artificial Sequence
  source: /note="Description of Artificial Sequence: Synthetic oligonucleotide"
auuauccuaauggguagca

SEQ ID NO: 1731 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuggaagccaugucaccatt

SEQ ID NO: 1732 - RNA, 19 nt, Artificial Sequence
  source: /note="Description of Artificial Sequence: Synthetic oligonucleotide"
acuggaagccaugucacca

SEQ ID NO: 1733 - RNA, 19 nt, Artificial Sequence
  source: /note="Description of Artificial Sequence: Synthetic oligonucleotide"
acuggaagccaugucacca

SEQ ID NO: 1734 - RNA, 19 nt, Artificial Sequence
  source: /note="Description of Artificial Sequence: Synthetic oligonucleotide"
acagggaaccucuaccuuc

SEQ ID NO: 1735 - RNA, 19 nt, Artificial Sequence
  source: /note="Description of Artificial Sequence: Synthetic oligonucleotide"
ccauugcgauuguccagag

SEQ ID NO: 1736 - RNA, 19 nt, Artificial Sequence
  source: /note="Description of Artificial Sequence: Synthetic oligonucleotide"
cgaagucguggaugccuug

SEQ ID NO: 1737 - RNA, 19 nt, Artificial Sequence
  source: /note="Description of Artificial Sequence: Synthetic oligonucleotide"
cuuuuucaccuaacuaaaa

SEQ ID NO: 1738 - RNA, 19 nt, Artificial Sequence
  source: /note="Description of Artificial Sequence: Synthetic oligonucleotide"
gaagucguggaugccuugg

SEQ ID NO: 1739 - RNA, 19 nt, Artificial Sequence
  source: /note="Description of Artificial Sequence: Synthetic oligonucleotide"
gagugagugacaacguacc

SEQ ID NO: 1740 - RNA, 19 nt, Artificial Sequence
  source: /note="Description of Artificial Sequence: Synthetic oligonucleotide"
gauaugccuucgaggauau

SEQ ID NO: 1741 - RNA, 19 nt, Artificial Sequence
  source: /note="Description of Artificial Sequence: Synthetic oligonucleotide"
ggagagauaugccuucgag

SEQ ID NO: 1742 - RNA, 19 nt, Artificial Sequence
  source: /note="Description of Artificial Sequence: Synthetic oligonucleotide"
ggauaaugucuuauguaau

SEQ ID NO: 1743 - RNA, 19 nt, Artificial Sequence
  source: /note="Description of Artificial Sequence: Synthetic oligonucleotide"
gguuuuaugaaaagcuagg

SEQ ID NO: 1744 - RNA, 19 nt, Artificial Sequence
  source: /note="Description of Artificial Sequence: Synthetic oligonucleotide"
ugcuacccauuaggauaau

SEQ ID NO: 1745 - RNA, 19 nt, Artificial Sequence
  source: /note="Description of Artificial Sequence: Synthetic oligonucleotide"
uggugacauggcuuccaga

SEQ ID NO: 1746 - RNA, 21 nt, Artificial Sequence
  source: /note="Description of Artificial Sequence: Synthetic oligonucleotide"
caugagcaagauuugcaacuu

SEQ ID NO: 1747 - RNA, 23 nt, Artificial Sequence
  source: /note="Description of Artificial Sequence: Synthetic oligonucleotide"
aaguugcaaaucuugcucaugua

SEQ ID NO: 1748 - RNA, 21 nt, Artificial Sequence
  source: /note="Description of Artificial Sequence: Synthetic oligonucleotide"
acuugcuacccauuaggauau

SEQ ID NO: 1749 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaucctaauggguagcaaguug

SEQ ID NO: 1750 - RNA, 21 nt, Artificial Sequence
  source: /note="Description of Artificial Sequence: Synthetic oligonucleotide"
caugagcaagauuugcaacuu

SEQ ID NO: 1751 - RNA, 23 nt, Artificial Sequence
  source: /note="Description of Artificial Sequence: Synthetic oligonucleotide"
aaguugcaaaucuugcucaugua

SEQ ID NO: 1752 - RNA, 21 nt, Artificial Sequence
  source: /note="Description of Artificial Sequence: Synthetic oligonucleotide"
aaagacgaagucguggaugcu

SEQ ID NO: 1753 - RNA, 23 nt, Artificial Sequence
  source: /note="Description of Artificial Sequence: Synthetic oligonucleotide"
agcauccacgacuucgucuuugg

SEQ ID NO: 1754 - RNA, 21 nt, Artificial Sequence
  source: /note="Description of Artificial Sequence: Synthetic oligonucleotide"
ugaugccaaaacaaccaucau

SEQ ID NO: 1755 - RNA, 23 nt, Artificial Sequence
  source: /note="Description of Artificial Sequence: Synthetic oligonucleotide"
augaugguuguuuuggcaucaau

SEQ ID NO: 1756 - RNA, 21 nt, Artificial Sequence
  source: /note="Description of Artificial Sequence: Synthetic oligonucleotide"
acuugcuacccauuaggauau

SEQ ID NO: 1757 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaucctaauggguagcaaguug

SEQ ID NO: 1758 - RNA, 21 nt, Artificial Sequence
  source: /note="Description of Artificial Sequence: Synthetic oligonucleotide"
aggauaaugucuuauguaauu

SEQ ID NO: 1759 - RNA, 23 nt, Artificial Sequence
  source: /note="Description of Artificial Sequence: Synthetic oligonucleotide"
aauuacauaagacauuauccuaa

SEQ ID NO: 1760 - RNA, 21 nt, Artificial Sequence
  source: /note="Description of Artificial Sequence: Synthetic oligonucleotide"
gagcugaguugguuuuaugau

SEQ ID NO: 1761 - RNA, 23 nt, Artificial Sequence
  source: /note="Description of Artificial Sequence: Synthetic oligonucleotide"
aucauaaaaccaacucagcucag

SEQ ID NO: 1762 - RNA, 21 nt, Artificial Sequence
  source: /note="Description of Artificial Sequence: Synthetic oligonucleotide"
caucagcaugcguuaauucau

SEQ ID NO: 1763 - RNA, 23 nt, Artificial Sequence
  source: /note="Description of Artificial Sequence: Synthetic oligonucleotide"
augaauuaacgcaugcugaugua

SEQ ID NO: 1764 - RNA, 21 nt, Artificial Sequence
  source: /note="Description of Artificial Sequence: Synthetic oligonucleotide"
gauaaccuugacuacuaaaau

SEQ ID NO: 1765 - RNA, 23 nt, Artificial Sequence
  source: /note="Description of Artificial Sequence: Synthetic oligonucleotide"
auuuuaguagucaagguuaucau

SEQ ID NO: 1766 - RNA, 21 nt, Artificial Sequence
  source: /note="Description of Artificial Sequence: Synthetic oligonucleotide"
gguaacaagaugauaaucuau

SEQ ID NO: 1767 - RNA, 23 nt, Artificial Sequence
  source: /note="Description of Artificial Sequence: Synthetic oligonucleotide"
auagauuaucaucuuguuacccc

SEQ ID NO: 1768 - RNA, 21 nt, Artificial Sequence
  source: /note="Description of Artificial Sequence: Synthetic oligonucleotide"
accuuuuucaccuaacuaaau

SEQ ID NO: 1769 - RNA, 23 nt, Artificial Sequence
  source: /note="Description of Artificial Sequence: Synthetic oligonucleotide"
auuuaguuaggugaaaaaggugu

SEQ ID NO: 1770 - RNA, 21 nt, Artificial Sequence
  source: /note="Description of Artificial Sequence: Synthetic oligonucleotide"
cuuuuucaccuaacuaaaauu

SEQ ID NO: 1771 - RNA, 23 nt, Artificial Sequence
  source: /note="Description of Artificial Sequence: Synthetic oligonucleotide"
aauuuuaguuaggugaaaaaggu

SEQ ID NO: 1772 - RNA, 21 nt, Artificial Sequence
  source: /note="Description of Artificial Sequence: Synthetic oligonucleotide"
uuuuucaccuaacuaaaauau

SEQ ID NO: 1773 - RNA, 23 nt, Artificial Sequence
  source: /note="Description of Artificial Sequence: Synthetic oligonucleotide"
auauuuuaguuaggugaaaaagg

SEQ ID NO: 1774 - RNA, 21 nt, Artificial Sequence
  source: /note="Description of Artificial Sequence: Synthetic oligonucleotide"
uuucaccuaacuaaaauaauu

SEQ ID NO: 1775 - RNA, 23 nt, Artificial Sequence
  source: /note="Description of Artificial Sequence: Synthetic oligonucleotide"
aauuauuuuaguuaggugaaaaa

SEQ ID NO: 1776 - RNA, 21 nt, Artificial Sequence
  source: /note="Description of Artificial Sequence: Synthetic oligonucleotide"
uucaccuaacuaaaauaaugu

SEQ ID NO: 1777 - RNA, 23 nt, Artificial Sequence
  source: /note="Description of Artificial Sequence: Synthetic oligonucleotide"
acauuauuuuaguuaggugaaaa

SEQ ID NO: 1778 - RNA, 21 nt, Artificial Sequence
  source: /note="Description of Artificial Sequence: Synthetic oligonucleotide"
caccuaacuaaaauaauguuu

SEQ ID NO: 1779 - RNA, 23 nt, Artificial Sequence
  source: /note="Description of Artificial Sequence: Synthetic oligonucleotide"
aaacauuauuuuaguuaggugaa

SEQ ID NO: 1780 - RNA, 21 nt, Artificial Sequence
  source: /note="Description of Artificial Sequence: Synthetic oligonucleotide"
uguuaccuguugaauuuuguu

SEQ ID NO: 1781 - RNA, 23 nt, Artificial Sequence
  source: /note="Description of Artificial Sequence: Synthetic oligonucleotide"
aacaaaauucaacagguaacaac

SEQ ID NO: 1782 - RNA, 21 nt, Artificial Sequence
  source: /note="Description of Artificial Sequence: Synthetic oligonucleotide"
uuaccuguugaauuuuguauu

SEQ ID NO: 1783 - RNA, 23 nt, Artificial Sequence
  source: /note="Description of Artificial Sequence: Synthetic oligonucleotide"
aauacaaaauucaacagguaaca

SEQ ID NO: 1784 - RNA, 21 nt, Artificial Sequence
  source: /note="Description of Artificial Sequence: Synthetic oligonucleotide"
uaccuguugaauuuuguauuu

SEQ ID NO: 1785 - RNA, 23 nt, Artificial Sequence
  source: /note="Description of Artificial Sequence: Synthetic oligonucleotide"
aaauacaaaauucaacagguaac

SEQ ID NO: 1786 - RNA, 21 nt, Artificial Sequence
  source: /note="Description of Artificial Sequence: Synthetic oligonucleotide"
accuguugaauuuuguauuau

SEQ ID NO: 1787 - RNA, 23 nt, Artificial Sequence
  source: /note="Description of Artificial Sequence: Synthetic oligonucleotide"
auaauacaaaauucaacagguaa

SEQ ID NO: 1788 - RNA, 21 nt, Artificial Sequence
  source: /note="Description of Artificial Sequence: Synthetic oligonucleotide"
aggauaaugucuuauguaauu

SEQ ID NO: 1789 - RNA, 23 nt, Artificial Sequence
  source: /note="Description of Artificial Sequence: Synthetic oligonucleotide"
aauuacauaagacauuauccuaa

SEQ ID NO: 1790 - RNA, 21 nt, Artificial Sequence
  source: /note="Description of Artificial Sequence: Synthetic oligonucleotide"
gagcugaguugguuuuaugau

SEQ ID NO: 1791 - RNA, 23 nt, Artificial Sequence
  source: /note="Description of Artificial Sequence: Synthetic oligonucleotide"
aucauaaaaccaacucagcucag

SEQ ID NO: 1792 - RNA, 21 nt, Artificial Sequence
  source: /note="Description of Artificial Sequence: Synthetic oligonucleotide"
accuuuuucaccuaacuaaau

SEQ ID NO: 1793 - RNA, 23 nt, Artificial Sequence
  source: /note="Description of Artificial Sequence: Synthetic oligonucleotide"
auuuaguuaggugaaaaaggugu

SEQ ID NO: 1794 - RNA, 21 nt, Artificial Sequence
  source: /note="Description of Artificial Sequence: Synthetic oligonucleotide"
gauaaccuugacuacuaaaau

SEQ ID NO: 1795 - RNA, 23 nt, Artificial Sequence
  source: /note="Description of Artificial Sequence: Synthetic oligonucleotide"
auuuuaguagucaagguuaucau

SEQ ID NO: 1796 - RNA, 21 nt, Artificial Sequence
  source: /note="Description of Artificial Sequence: Synthetic oligonucleotide"
gauaaccuugacuacuaaaau

SEQ ID NO: 1797 - RNA, 23 nt, Artificial Sequence
  source: /note="Description of Artificial Sequence: Synthetic oligonucleotide"
auuuuaguagucaagguuaucau

SEQ ID NO: 1798 - RNA, 21 nt, Artificial Sequence
  source: /note="Description of Artificial Sequence: Synthetic oligonucleotide"
aggauaaugucuuauguaauu

SEQ ID NO: 1799 - RNA, 23 nt, Artificial Sequence
  source: /note="Description of Artificial Sequence: Synthetic oligonucleotide"
aauuacauaagacauuauccuaa

SEQ ID NO: 1800 - RNA, 21 nt, Artificial Sequence
  source: /note="Description of Artificial Sequence: Synthetic oligonucleotide"
gagcugaguugguuuuaugau

SEQ ID NO: 1801 - RNA, 23 nt, Artificial Sequence
  source: /note="Description of Artificial Sequence: Synthetic oligonucleotide"
aucauaaaaccaacucagcucag

SEQ ID NO: 1802 - RNA, 21 nt, Artificial Sequence
  source: /note="Description of Artificial Sequence: Synthetic oligonucleotide"
accuuuuucaccuaacuaaau

SEQ ID NO: 1803 - RNA, 23 nt, Artificial Sequence
  source: /note="Description of Artificial Sequence: Synthetic oligonucleotide"
auuuaguuaggugaaaaaggugu

SEQ ID NO: 1804 - RNA, 21 nt, Artificial Sequence
  source: /note="Description of Artificial Sequence: Synthetic oligonucleotide"
guccucucagaucuugugcgu

SEQ ID NO: 1805 - RNA, 21 nt, Artificial Sequence
  source: /note="Description of Artificial Sequence: Synthetic oligonucleotide"
cauccauccuucaacuuaagu

SEQ ID NO: 1806 - RNA, 21 nt, Artificial Sequence
  source: /note="Description of Artificial Sequence: Synthetic oligonucleotide"
auccauccuucaacuuaagcu

SEQ ID NO: 1807 - RNA, 21 nt, Artificial Sequence
  source: /note="Description of Artificial Sequence: Synthetic oligonucleotide"
uccauccuucaacuuaagcau

SEQ ID NO: 1808 - RNA, 21 nt, Artificial Sequence
  source: /note="Description of Artificial Sequence: Synthetic oligonucleotide"
uuaagcaaguuccuccgacau

SEQ ID NO: 1809 - RNA, 21 nt, Artificial Sequence
  source: /note="Description of Artificial Sequence: Synthetic oligonucleotide"
gcaaaauaggcaucucucuuu

SEQ ID NO: 1810 - RNA, 21 nt, Artificial Sequence
  source: /note="Description of Artificial Sequence: Synthetic oligonucleotide"
aaaauaggcaucucucuuacu

SEQ ID NO: 1811 - RNA, 21 nt, Artificial Sequence
  source: /note="Description of Artificial Sequence: Synthetic oligonucleotide"
aaauaggcaucucucuuaccu

SEQ ID NO: 1812 - RNA, 21 nt, Artificial Sequence
  source: /note="Description of Artificial Sequence: Synthetic oligonucleotide"
auaggcaucucucuuaccagu

SEQ ID NO: 1813 - RNA, 21 nt, Artificial Sequence
  source: /note="Description of Artificial Sequence: Synthetic oligonucleotide"
aucucucuuaccagagugucu

SEQ ID NO: 1814 - RNA, 21 nt, Artificial Sequence
  source: /note="Description of Artificial Sequence: Synthetic oligonucleotide"
acuuucgguccaaagacgaau

SEQ ID NO: 1815 - RNA, 21 nt, Artificial Sequence
  source: /note="Description of Artificial Sequence: Synthetic oligonucleotide"
uuucgguccaaagacgaaguu

SEQ ID NO: 1816 - RNA, 21 nt, Artificial Sequence
  source: /note="Description of Artificial Sequence: Synthetic oligonucleotide"
cgguccaaagacgaagucguu

SEQ ID NO: 1817 - RNA, 21 nt, Artificial Sequence
  source: /note="Description of Artificial Sequence: Synthetic oligonucleotide"
gguccaaagacgaagucgugu

SEQ ID NO: 1818 - RNA, 21 nt, Artificial Sequence
  source: /note="Description of Artificial Sequence: Synthetic oligonucleotide"
uugguauguuccugcuucauu

SEQ ID NO: 1819 - RNA, 21 nt, Artificial Sequence
  source: /note="Description of Artificial Sequence: Synthetic oligonucleotide"
ugacaacguacccuucauugu

SEQ ID NO: 1820 - RNA, 21 nt, Artificial Sequence
  source: /note="Description of Artificial Sequence: Synthetic oligonucleotide"
gacaacguacccuucauugau

SEQ ID NO: 1821 - RNA, 21 nt, Artificial Sequence
  source: /note="Description of Artificial Sequence: Synthetic oligonucleotide"
acaacguacccuucauugauu

SEQ ID NO: 1822 - RNA, 21 nt, Artificial Sequence
  source: /note="Description of Artificial Sequence: Synthetic oligonucleotide"
caacguacccuucauugaugu

SEQ ID NO: 1823 - RNA, 21 nt, Artificial Sequence
  source: /note="Description of Artificial Sequence: Synthetic oligonucleotide"
aacguacccuucauugaugcu

SEQ ID NO: 1824 - RNA, 21 nt, Artificial Sequence
  source: /note="Description of Artificial Sequence: Synthetic oligonucleotide"
uaaagucaaguccacgaacuu

SEQ ID NO: 1825 - RNA, 21 nt, Artificial Sequence
  source: /note="Description of Artificial Sequence: Synthetic oligonucleotide"
aaagucaaguccacgaacuuu

SEQ ID NO: 1826 - RNA, 21 nt, Artificial Sequence
  source: /note="Description of Artificial Sequence: Synthetic oligonucleotide"
uccacgaacuuucuucauguu

SEQ ID NO: 1827 - RNA, 21 nt, Artificial Sequence
  source: /note="Description of Artificial Sequence: Synthetic oligonucleotide"
ccacgaacuuucuucaugugu

SEQ ID NO: 1828 - RNA, 21 nt, Artificial Sequence
  source: /note="Description of Artificial Sequence: Synthetic oligonucleotide"
cacgaacuuucuucauguggu

SEQ ID NO: 1829 - RNA, 21 nt, Artificial Sequence
  source: /note="Description of Artificial Sequence: Synthetic oligonucleotide"
acgaacuuucuucauguggau

SEQ ID NO: 1830 - RNA, 21 nt, Artificial Sequence
  source: /note="Description of Artificial Sequence: Synthetic oligonucleotide"
cgaacuuucuucauguggacu

SEQ ID NO: 1831 - RNA, 21 nt, Artificial Sequence
  source: /note="Description of Artificial Sequence: Synthetic oligonucleotide"
uucucucgagagcuuuugucu

SEQ ID NO: 1832 - RNA, 21 nt, Artificial Sequence
  source: /note="Description of Artificial Sequence: Synthetic oligonucleotide"
ugcuacccauuaggauaaugu

SEQ ID NO: 1833 - RNA, 21 nt, Artificial Sequence
  source: /note="Description of Artificial Sequence: Synthetic oligonucleotide"
gcuacccauuaggauaauguu

SEQ ID NO: 1834 - RNA, 21 nt, Artificial Sequence
  source: /note="Description of Artificial Sequence: Synthetic oligonucleotide"
cuacccauuaggauaaugucu

SEQ ID NO: 1835 - RNA, 21 nt, Artificial Sequence
  source: /note="Description of Artificial Sequence: Synthetic oligonucleotide"
uacccauuaggauaaugucuu

SEQ ID NO: 1836 - RNA, 21 nt, Artificial Sequence
  source: /note="Description of Artificial Sequence: Synthetic oligonucleotide"
acccauuaggauaaugucuuu

SEQ ID NO: 1837 - RNA, 21 nt, Artificial Sequence
  source: /note="Description of Artificial Sequence: Synthetic oligonucleotide"
uuaggauaaugucuuauguau

SEQ ID NO: 1838 - RNA, 21 nt, Artificial Sequence
  source: /note="Description of Artificial Sequence: Synthetic oligonucleotide"
uaggauaaugucuuauguaau

SEQ ID NO: 1839 - RNA, 21 nt, Artificial Sequence
  source: /note="Description of Artificial Sequence: Synthetic oligonucleotide"
ucacagguguucacucgaguu

SEQ ID NO: 1840 - RNA, 21 nt, Artificial Sequence
  source: /note="Description of Artificial Sequence: Synthetic oligonucleotide"
cuugggcaauaaaguaccugu

SEQ ID NO: 1841 - RNA, 21 nt, Artificial Sequence
  source: /note="Description of Artificial Sequence: Synthetic oligonucleotide"
uucccaguuuuucacuagagu

SEQ ID NO: 1842 - RNA, 21 nt, Artificial Sequence
  source: /note="Description of Artificial Sequence: Synthetic oligonucleotide"
ggcgagucuagcagauucuuu

SEQ ID NO: 1843 - RNA, 21 nt, Artificial Sequence
  source: /note="Description of Artificial Sequence: Synthetic oligonucleotide"
gcgagucuagcagauucuuuu

SEQ ID NO: 1844 - RNA, 21 nt, Artificial Sequence
  source: /note="Description of Artificial Sequence: Synthetic oligonucleotide"
cgagucuagcagauucuuucu

SEQ ID NO: 1845 - RNA, 21 nt, Artificial Sequence
  source: /note="Description of Artificial Sequence: Synthetic oligonucleotide"
gagucuagcagauucuuucau

SEQ ID NO: 1846 - RNA, 21 nt, Artificial Sequence
  source: /note="Description of Artificial Sequence: Synthetic oligonucleotide"
agucuagcagauucuuucagu

SEQ ID NO: 1847 - RNA, 21 nt, Artificial Sequence
  source: /note="Description of Artificial Sequence: Synthetic oligonucleotide"
gucuagcagauucuuucagau

SEQ ID NO: 1848 - RNA, 21 nt, Artificial Sequence
  source: /note="Description of Artificial Sequence: Synthetic oligonucleotide"
ucuagcagauucuuucagagu

SEQ ID NO: 1849 - RNA, 21 nt, Artificial Sequence
  source: /note="Description of Artificial Sequence: Synthetic oligonucleotide"
ugcuaaaguuucccaucuuuu

SEQ ID NO: 1850 - RNA, 21 nt, Artificial Sequence
  source: /note="Description of Artificial Sequence: Synthetic oligonucleotide"
gcuaaaguuucccaucuuugu

SEQ ID NO: 1851 - RNA, 21 nt, Artificial Sequence
  source: /note="Description of Artificial Sequence: Synthetic oligonucleotide"
cuaaaguuucccaucuuuguu

SEQ ID NO: 1852 - RNA, 21 nt, Artificial Sequence
  source: /note="Description of Artificial Sequence: Synthetic oligonucleotide"
uaaaguuucccaucuuugugu

SEQ ID NO: 1853 - RNA, 21 nt, Artificial Sequence
  source: /note="Description of Artificial Sequence: Synthetic oligonucleotide"
aaguuucccaucuuugugcau

SEQ ID NO: 1854 - RNA, 21 nt, Artificial Sequence
  source: /note="Description of Artificial Sequence: Synthetic oligonucleotide"
ucugagcugaguugguuuuau

SEQ ID NO: 1855 - RNA, 21 nt, Artificial Sequence
  source: /note="Description of Artificial Sequence: Synthetic oligonucleotide"
cugagcugaguugguuuuauu

SEQ ID NO: 1856 - RNA, 21 nt, Artificial Sequence
  source: /note="Description of Artificial Sequence: Synthetic oligonucleotide"
ugagcugaguugguuuuaugu

SEQ ID NO: 1857 - RNA, 21 nt, Artificial Sequence
  source: /note="Description of Artificial Sequence: Synthetic oligonucleotide"
gagcugaguugguuuuaugau

SEQ ID NO: 1858 - RNA, 21 nt, Artificial Sequence
  source: /note="Description of Artificial Sequence: Synthetic oligonucleotide"
agcugaguugguuuuaugaau

SEQ ID NO: 1859 - RNA, 21 nt, Artificial Sequence
  source: /note="Description of Artificial Sequence: Synthetic oligonucleotide"
gaguugguuuuaugaaaagcu

SEQ ID NO: 1860 - RNA, 21 nt, Artificial Sequence
  source: /note="Description of Artificial Sequence: Synthetic oligonucleotide"
aguugguuuuaugaaaagcuu

SEQ ID NO: 1861 - RNA, 21 nt, Artificial Sequence
  source: /note="Description of Artificial Sequence: Synthetic oligonucleotide"
guugguuuuaugaaaagcuau

SEQ ID NO: 1862 - RNA, 21 nt, Artificial Sequence
  source: /note="Description of Artificial Sequence: Synthetic oligonucleotide"
uuuuaugaaaagcuaggaagu

SEQ ID NO: 1863 - RNA, 21 nt, Artificial Sequence
  source: /note="Description of Artificial Sequence: Synthetic oligonucleotide"
aaaagcuaggaagcaaccuuu

SEQ ID NO: 1864 - RNA, 21 nt, Artificial Sequence
  source: /note="Description of Artificial Sequence: Synthetic oligonucleotide"
agcuaggaagcaaccuuucgu

SEQ ID NO: 1865 - RNA, 21 nt, Artificial Sequence
  source: /note="Description of Artificial Sequence: Synthetic oligonucleotide"
gcuaggaagcaaccuuucgcu

SEQ ID NO: 1866 - RNA, 21 nt, Artificial Sequence
  source: /note="Description of Artificial Sequence: Synthetic oligonucleotide"
uaggaagcaaccuuucgccuu

SEQ ID NO: 1867 - RNA, 21 nt, Artificial Sequence
  source: /note="Description of Artificial Sequence: Synthetic oligonucleotide"
ccagcacuuaacucuaauacu

SEQ ID NO: 1868 - RNA, 21 nt, Artificial Sequence
  source: /note="Description of Artificial Sequence: Synthetic oligonucleotide"
cagcacuuaacucuaauacau

SEQ ID NO: 1869 - RNA, 21 nt, Artificial Sequence
  source: /note="Description of Artificial Sequence: Synthetic oligonucleotide"
agcacuuaacucuaauacauu

SEQ ID NO: 1870 - RNA, 21 nt, Artificial Sequence
  source: /note="Description of Artificial Sequence: Synthetic oligonucleotide"
acuuaacucuaauacaucagu

SEQ ID NO: 1871 - RNA, 21 nt, Artificial Sequence
  source: /note="Description of Artificial Sequence: Synthetic oligonucleotide"
cucuaauacaucagcaugcgu

SEQ ID NO: 1872 - RNA, 21 nt, Artificial Sequence
  source: /note="Description of Artificial Sequence: Synthetic oligonucleotide"
ucuaauacaucagcaugcguu

SEQ ID NO: 1873 - RNA, 21 nt, Artificial Sequence
  source: /note="Description of Artificial Sequence: Synthetic oligonucleotide"
cuaauacaucagcaugcguuu

SEQ ID NO: 1874 - RNA, 21 nt, Artificial Sequence
  source: /note="Description of Artificial Sequence: Synthetic oligonucleotide"
uaauacaucagcaugcguuau

SEQ ID NO: 1875 - RNA, 21 nt, Artificial Sequence
  source: /note="Description of Artificial Sequence: Synthetic oligonucleotide"
uacaucagcaugcguuaauuu

SEQ ID NO: 1876 - RNA, 21 nt, Artificial Sequence
  source: /note="Description of Artificial Sequence: Synthetic oligonucleotide"
acaucagcaugcguuaauucu

SEQ ID NO: 1877 - RNA, 21 nt, Artificial Sequence
  source: /note="Description of Artificial Sequence: Synthetic oligonucleotide"
caucagcaugcguuaauucau

SEQ ID NO: 1878 - RNA, 21 nt, Artificial Sequence
  source: /note="Description of Artificial Sequence: Synthetic oligonucleotide"
ucagcaugcguuaauucagcu

SEQ ID NO: 1879 - RNA, 21 nt, Artificial Sequence
  source: /note="Description of Artificial Sequence: Synthetic oligonucleotide"
agcaugcguuaauucagcugu

SEQ ID NO: 1880 - RNA, 21 nt, Artificial Sequence
  source: /note="Description of Artificial Sequence: Synthetic oligonucleotide"
gucccuuacugacuguuucgu

SEQ ID NO: 1881 - RNA, 21 nt, Artificial Sequence
  source: /note="Description of Artificial Sequence: Synthetic oligonucleotide"
ucccuuacugacuguuucguu

SEQ ID NO: 1882 - RNA, 21 nt, Artificial Sequence
  source: /note="Description of Artificial Sequence: Synthetic oligonucleotide"
cccuuacugacuguuucgugu

SEQ ID NO: 1883 - RNA, 21 nt, Artificial Sequence
  source: /note="Description of Artificial Sequence: Synthetic oligonucleotide"
ccuuacugacuguuucguggu

SEQ ID NO: 1884 - RNA, 21 nt, Artificial Sequence
  source: /note="Description of Artificial Sequence: Synthetic oligonucleotide"
uuccagcaugagguucuuagu

SEQ ID NO: 1885 - RNA, 21 nt, Artificial Sequence
  source: /note="Description of Artificial Sequence: Synthetic oligonucleotide"
ccagcaugagguucuuagaau

SEQ ID NO: 1886 - RNA, 21 nt, Artificial Sequence
  source: /note="Description of Artificial Sequence: Synthetic oligonucleotide"
cagcaugagguucuuagaauu

SEQ ID NO: 1887 - RNA, 21 nt, Artificial Sequence
  source: /note="Description of Artificial Sequence: Synthetic oligonucleotide"
agcaugagguucuuagaaugu

SEQ ID NO: 1888 - RNA, 21 nt, Artificial Sequence
  source: /note="Description of Artificial Sequence: Synthetic oligonucleotide"
caugagguucuuagaaugacu

SEQ ID NO: 1889 - RNA, 21 nt, Artificial Sequence
  source: /note="Description of Artificial Sequence: Synthetic oligonucleotide"
uucuuagaaugacagguguuu

SEQ ID NO: 1890 - RNA, 21 nt, Artificial Sequence
  source: /note="Description of Artificial Sequence: Synthetic oligonucleotide"
ggucugcaaagaugauaaccu

SEQ ID NO: 1891 - RNA, 21 nt, Artificial Sequence
  source: /note="Description of Artificial Sequence: Synthetic oligonucleotide"
gucugcaaagaugauaaccuu

SEQ ID NO: 1892 - RNA, 21 nt, Artificial Sequence
  source: /note="Description of Artificial Sequence: Synthetic oligonucleotide"
ucugcaaagaugauaaccuuu

SEQ ID NO: 1893 - RNA, 21 nt, Artificial Sequence
  source: /note="Description of Artificial Sequence: Synthetic oligonucleotide"
cugcaaagaugauaaccuugu

SEQ ID NO: 1894 - RNA, 21 nt, Artificial Sequence
  source: /note="Description of Artificial Sequence: Synthetic oligonucleotide"
caaagaugauaaccuugacuu

SEQ ID NO: 1895 - RNA, 21 nt, Artificial Sequence
  source: /note="Description of Artificial Sequence: Synthetic oligonucleotide"
uaaccuugacuacuaaaaacu

SEQ ID NO: 1896 - RNA, 21 nt, Artificial Sequence
  source: /note="Description of Artificial Sequence: Synthetic oligonucleotide"
aaccuugacuacuaaaaacgu

SEQ ID NO: 1897 - RNA, 21 nt, Artificial Sequence
  source: /note="Description of Artificial Sequence: Synthetic oligonucleotide"
accuugacuacuaaaaacguu

SEQ ID NO: 1898 - RNA, 21 nt, Artificial Sequence
  source: /note="Description of Artificial Sequence: Synthetic oligonucleotide"
ccuugacuacuaaaaacgucu

SEQ ID NO: 1899 - RNA, 21 nt, Artificial Sequence
  source: /note="Description of Artificial Sequence: Synthetic oligonucleotide"
cuugacuacuaaaaacgucuu

SEQ ID NO: 1900 - RNA, 21 nt, Artificial Sequence
  source: /note="Description of Artificial Sequence: Synthetic oligonucleotide"
uugacuacuaaaaacgucucu

SEQ ID NO: 1901 - RNA, 21 nt, Artificial Sequence
  source: /note="Description of Artificial Sequence: Synthetic oligonucleotide"
ggguaacaagaugauaaucuu

SEQ ID NO: 1902 - RNA, 21 nt, Artificial Sequence
  source: /note="Description of Artificial Sequence: Synthetic oligonucleotide"
gguaacaagaugauaaucuau

SEQ ID NO: 1903 - RNA, 21 nt, Artificial Sequence
  source: /note="Description of Artificial Sequence: Synthetic oligonucleotide"
guaacaagaugauaaucuacu

SEQ ID NO: 1904 - RNA, 21 nt, Artificial Sequence
  source: /note="Description of Artificial Sequence: Synthetic oligonucleotide"
uaacaagaugauaaucuacuu

SEQ ID NO: 1905 - RNA, 21 nt, Artificial Sequence
  source: /note="Description of Artificial Sequence: Synthetic oligonucleotide"
aacaagaugauaaucuacuuu

SEQ ID NO: 1906 - RNA, 21 nt, Artificial Sequence
  source: /note="Description of Artificial Sequence: Synthetic oligonucleotide"
uuuuagaacaccuuuuucacu

SEQ ID NO: 1907 - RNA, 21 nt, Artificial Sequence
  source: /note="Description of Artificial Sequence: Synthetic oligonucleotide"
acaccuuuuucaccuaacuau

SEQ ID NO: 1908 - RNA, 21 nt, Artificial Sequence
  source: /note="Description of Artificial Sequence: Synthetic oligonucleotide"
caccuuuuucaccuaacuaau

SEQ ID NO: 1909 - RNA, 21 nt, Artificial Sequence
  source: /note="Description of Artificial Sequence: Synthetic oligonucleotide"
cuuuuucaccuaacuaaaauu

SEQ ID NO: 1910 - RNA, 21 nt, Artificial Sequence
  source: /note="Description of Artificial Sequence: Synthetic oligonucleotide"
uuuuucaccuaacuaaaauau

SEQ ID NO: 1911 - RNA, 21 nt, Artificial Sequence
  source: /note="Description of Artificial Sequence: Synthetic oligonucleotide"
uuuucaccuaacuaaaauaau

SEQ ID NO: 1912 - RNA, 21 nt, Artificial Sequence
  source: /note="Description of Artificial Sequence: Synthetic oligonucleotide"
uuucaccuaacuaaaauaauu

SEQ ID NO: 1913 - RNA, 21 nt, Artificial Sequence
  source: /note="Description of Artificial Sequence: Synthetic oligonucleotide"
uucaccuaacuaaaauaaugu

SEQ ID NO: 1914 - RNA, 21 nt, Artificial Sequence
  source: /note="Description of Artificial Sequence: Synthetic oligonucleotide"
ucaccuaacuaaaauaauguu

SEQ ID NO: 1915 - RNA, 21 nt, Artificial Sequence
  source: /note="Description of Artificial Sequence: Synthetic oligonucleotide"
caccuaacuaaaauaauguuu

SEQ ID NO: 1916 - RNA, 21 nt, Artificial Sequence
  source: /note="Description of Artificial Sequence: Synthetic oligonucleotide"
auguaaggaagcguuguuacu

SEQ ID NO: 1917 - RNA, 21 nt, Artificial Sequence
  source: /note="Description of Artificial Sequence: Synthetic oligonucleotide"
aagcguuguuaccuguugaau

SEQ ID NO: 1918 - RNA, 21 nt, Artificial Sequence
  source: /note="Description of Artificial Sequence: Synthetic oligonucleotide"
agcguuguuaccuguugaauu

SEQ ID NO: 1919 - RNA, 21 nt, Artificial Sequence
  source: /note="Description of Artificial Sequence: Synthetic oligonucleotide"
guuguuaccuguugaauuuuu

SEQ ID NO: 1920 - RNA, 21 nt, Artificial Sequence
  source: /note="Description of Artificial Sequence: Synthetic oligonucleotide"
uuguuaccuguugaauuuugu

SEQ ID NO: 1921 - RNA, 21 nt, Artificial Sequence
  source: /note="Description of Artificial Sequence: Synthetic oligonucleotide"
uguuaccuguugaauuuuguu

SEQ ID NO: 1922 - RNA, 21 nt, Artificial Sequence
  source: /note="Description of Artificial Sequence: Synthetic oligonucleotide"
uuaccuguugaauuuuguauu

SEQ ID NO: 1923 - RNA, 21 nt, Artificial Sequence
  source: /note="Description of Artificial Sequence: Synthetic oligonucleotide"
uaccuguugaauuuuguauuu

SEQ ID NO: 1924 - RNA, 21 nt, Artificial Sequence
  source: /note="Description of Artificial Sequence: Synthetic oligonucleotide"
accuguugaauuuuguauuau

SEQ ID NO: 1925 - RNA, 21 nt, Artificial Sequence
  source: /note="Description of Artificial Sequence: Synthetic oligonucleotide"
cuguugaauuuuguauuaugu

SEQ ID NO: 1926 - RNA, 21 nt, Artificial Sequence
  source: /note="Description of Artificial Sequence: Synthetic oligonucleotide"
guugaauuuuguauuaugugu

SEQ ID NO: 1927 - RNA, 21 nt, Artificial Sequence
  source: /note="Description of Artificial Sequence: Synthetic oligonucleotide"
cagugagauguuaguagaauu

SEQ ID NO: 1928 - RNA, 21 nt, Artificial Sequence
  source: /note="Description of Artificial Sequence: Synthetic oligonucleotide"
gagauguuaguagaauaagcu

SEQ ID NO: 1929 - RNA, 21 nt, Artificial Sequence
  source: /note="Description of Artificial Sequence: Synthetic oligonucleotide"
uaguagaauaagccuuaaaau

SEQ ID NO: 1930 - RNA, 21 nt, Artificial Sequence
  source: /note="Description of Artificial Sequence: Synthetic oligonucleotide"
gcugagauugcaccauuucau

SEQ ID NO: 1931 - RNA, 21 nt, Artificial Sequence
  source: /note="Description of Artificial Sequence: Synthetic oligonucleotide"
cugagauugcaccauuucauu

SEQ ID NO: 1932 - RNA, 21 nt, Artificial Sequence
  source: /note="Description of Artificial Sequence: Synthetic oligonucleotide"
ugagauugcaccauuucauuu

SEQ ID NO: 1933 - RNA, 21 nt, Artificial Sequence
  source: /note="Description of Artificial Sequence: Synthetic oligonucleotide"
agauugcaccauuucauuccu

SEQ ID NO: 1934 - RNA, 21 nt, Artificial Sequence
  source: /note="Description of Artificial Sequence: Synthetic oligonucleotide"
aacaaaauaaucuagugugcu

SEQ ID NO: 1935 - RNA, 21 nt, Artificial Sequence
  source: /note="Description of Artificial Sequence: Synthetic oligonucleotide"
caaaauaaucuagugugcagu

SEQ ID NO: 1936 - RNA, 21 nt, Artificial Sequence
  source: /note="Description of Artificial Sequence: Synthetic oligonucleotide"
uugaaccuggcuuauuuucuu

SEQ ID NO: 1937 - RNA, 21 nt, Artificial Sequence
  source: /note="Description of Artificial Sequence: Synthetic oligonucleotide"
cacauggucagugaguuucuu

SEQ ID NO: 1938 - RNA, 23 nt, Artificial Sequence
  source: /note="Description of Artificial Sequence: Synthetic oligonucleotide"
acgcacaagaucugagaggaccu

SEQ ID NO: 1939 - RNA, 23 nt, Artificial Sequence
  source: /note="Description of Artificial Sequence: Synthetic oligonucleotide"
acuuaaguugaaggauggaugga

SEQ ID NO: 1940 - RNA, 23 nt, Artificial Sequence
  source: /note="Description of Artificial Sequence: Synthetic oligonucleotide"
agcuuaaguugaaggauggaugg

SEQ ID NO: 1941 - RNA, 23 nt, Artificial Sequence
  source: /note="Description of Artificial Sequence: Synthetic oligonucleotide"
augcuuaaguugaaggauggaug

SEQ ID NO: 1942 - RNA, 23 nt, Artificial Sequence
  source: /note="Description of Artificial Sequence: Synthetic oligonucleotide"
augucggaggaacuugcuuaagu

SEQ ID NO: 1943 - RNA, 23 nt, Artificial Sequence
  source: /note="Description of Artificial Sequence: Synthetic oligonucleotide"
aaagagagaugccuauuuugccg

SEQ ID NO: 1944 - RNA, 23 nt, Artificial Sequence
  source: /note="Description of Artificial Sequence: Synthetic oligonucleotide"
aguaagagagaugccuauuuugc

SEQ ID NO: 1945 - RNA, 23 nt, Artificial Sequence
  source: /note="Description of Artificial Sequence: Synthetic oligonucleotide"
agguaagagagaugccuauuuug

SEQ ID NO: 1946 - RNA, 23 nt, Artificial Sequence
  source: /note="Description of Artificial Sequence: Synthetic oligonucleotide"
acugguaagagagaugccuauuu

SEQ ID NO: 1947 - RNA, 23 nt, Artificial Sequence
  source: /note="Description of Artificial Sequence: Synthetic oligonucleotide"
agacacucugguaagagagaugc

SEQ ID NO: 1948 - RNA, 23 nt, Artificial Sequence
  source: /note="Description of Artificial Sequence: Synthetic oligonucleotide"
auucgucuuuggaccgaaaguca

SEQ ID NO: 1949 - RNA, 23 nt, Artificial Sequence
  source: /note="Description of Artificial Sequence: Synthetic oligonucleotide"
aacuucgucuuuggaccgaaagu

SEQ ID NO: 1950 - RNA, 23 nt, Artificial Sequence
  source: /note="Description of Artificial Sequence: Synthetic oligonucleotide"
aacgacuucgucuuuggaccgaa

SEQ ID NO: 1951 - RNA, 23 nt, Artificial Sequence
  source: /note="Description of Artificial Sequence: Synthetic oligonucleotide"
acacgacuucgucuuuggaccga

SEQ ID NO: 1952 - RNA, 23 nt, Artificial Sequence
  source: /note="Description of Artificial Sequence: Synthetic oligonucleotide"
aaugaagcaggaacauaccaagg

SEQ ID NO: 1953 - RNA, 23 nt, Artificial Sequence
  source: /note="Description of Artificial Sequence: Synthetic oligonucleotide"
acaaugaaggguacguugucacu

SEQ ID NO: 1954 - RNA, 23 nt, Artificial Sequence
  source: /note="Description of Artificial Sequence: Synthetic oligonucleotide"
aucaaugaaggguacguugucac

SEQ ID NO: 1955 - RNA, 23 nt, Artificial Sequence
  source: /note="Description of Artificial Sequence: Synthetic oligonucleotide"
aaucaaugaaggguacguuguca

SEQ ID NO: 1956 - RNA, 23 nt, Artificial Sequence
  source: /note="Description of Artificial Sequence: Synthetic oligonucleotide"
acaucaaugaaggguacguuguc

SEQ ID NO: 1957 - RNA, 23 nt, Artificial Sequence
  source: /note="Description of Artificial Sequence: Synthetic oligonucleotide"
agcaucaaugaaggguacguugu

SEQ ID NO: 1958 - RNA, 23 nt, Artificial Sequence
  source: /note="Description of Artificial Sequence: Synthetic oligonucleotide"
aaguucguggacuugacuuuagg

SEQ ID NO: 1959 - RNA, 23 nt, Artificial Sequence
  source: /note="Description of Artificial Sequence: Synthetic oligonucleotide"
aaaguucguggacuugacuuuag

SEQ ID NO: 1960 - RNA, 23 nt, Artificial Sequence
  source: /note="Description of Artificial Sequence: Synthetic oligonucleotide"
aacaugaagaaaguucguggacu

SEQ ID NO: 1961 - RNA, 23 nt, Artificial Sequence
  source: /note="Description of Artificial Sequence: Synthetic oligonucleotide"
acacaugaagaaaguucguggac

SEQ ID NO: 1962 - RNA, 23 nt, Artificial Sequence
  source: /note="Description of Artificial Sequence: Synthetic oligonucleotide"
accacaugaagaaaguucgugga

SEQ ID NO: 1963 - RNA, 23 nt, Artificial Sequence
  source: /note="Description of Artificial Sequence: Synthetic oligonucleotide"
auccacaugaagaaaguucgugg

SEQ ID NO: 1964 - RNA, 23 nt, Artificial Sequence
  source: /note="Description of Artificial Sequence: Synthetic oligonucleotide"
aguccacaugaagaaaguucgug

SEQ ID NO: 1965 - RNA, 23 nt, Artificial Sequence
  source: /note="Description of Artificial Sequence: Synthetic oligonucleotide"
agacaaaagcucucgagagaagg

SEQ ID NO: 1966 - RNA, 23 nt, Artificial Sequence
  source: /note="Description of Artificial Sequence: Synthetic oligonucleotide"
acauuauccuaauggguagcaag

SEQ ID NO: 1967 - RNA, 23 nt, Artificial Sequence
  source: /note="Description of Artificial Sequence: Synthetic oligonucleotide"
aacauuauccuaauggguagcaa

SEQ ID NO: 1968 - RNA, 23 nt, Artificial Sequence
  source: /note="Description of Artificial Sequence: Synthetic oligonucleotide"
agacauuauccuaauggguagca

SEQ ID NO: 1969 - RNA, 23 nt, Artificial Sequence
  source: /note="Description of Artificial Sequence: Synthetic oligonucleotide"
aagacauuauccuaauggguagc

SEQ ID NO: 1970 - RNA, 23 nt, Artificial Sequence
  source: /note="Description of Artificial Sequence: Synthetic oligonucleotide"
aaagacauuauccuaauggguag

SEQ ID NO: 1971 - RNA, 23 nt, Artificial Sequence
  source: /note="Description of Artificial Sequence: Synthetic oligonucleotide"
auacauaagacauuauccuaaug

SEQ ID NO: 1972 - RNA, 23 nt, Artificial Sequence
  source: /note="Description of Artificial Sequence: Synthetic oligonucleotide"
auuacauaagacauuauccuaau

SEQ ID NO: 1973 - RNA, 23 nt, Artificial Sequence
  source: /note="Description of Artificial Sequence: Synthetic oligonucleotide"
aacucgagugaacaccugugagg

SEQ ID NO: 1974 - RNA, 23 nt, Artificial Sequence
  source: /note="Description of Artificial Sequence: Synthetic oligonucleotide"
acagguacuuuauugcccaagaa

SEQ ID NO: 1975 - RNA, 23 nt, Artificial Sequence
  source: /note="Description of Artificial Sequence: Synthetic oligonucleotide"
acucuagugaaaaacugggaaag

SEQ ID NO: 1976 - RNA, 23 nt, Artificial Sequence
  source: /note="Description of Artificial Sequence: Synthetic oligonucleotide"
aaagaaucugcuagacucgccuc

SEQ ID NO: 1977 - RNA, 23 nt, Artificial Sequence
  source: /note="Description of Artificial Sequence: Synthetic oligonucleotide"
aaaagaaucugcuagacucgccu

SEQ ID NO: 1978 - RNA, 23 nt, Artificial Sequence
  source: /note="Description of Artificial Sequence: Synthetic oligonucleotide"
agaaagaaucugcuagacucgcc

SEQ ID NO: 1979 - RNA, 23 nt, Artificial Sequence
  source: /note="Description of Artificial Sequence: Synthetic oligonucleotide"
augaaagaaucugcuagacucgc

SEQ ID NO: 1980 - RNA, 23 nt, Artificial Sequence
  source: /note="Description of Artificial Sequence: Synthetic oligonucleotide"
acugaaagaaucugcuagacucg

SEQ ID NO: 1981 - RNA, 23 nt, Artificial Sequence
  source: /note="Description of Artificial Sequence: Synthetic oligonucleotide"
aucugaaagaaucugcuagacuc

SEQ ID NO: 1982 - RNA, 23 nt, Artificial Sequence
  source: /note="Description of Artificial Sequence: Synthetic oligonucleotide"
acucugaaagaaucugcuagacu

SEQ ID NO: 1983 - RNA, 23 nt, Artificial Sequence
  source: /note="Description of Artificial Sequence: Synthetic oligonucleotide"
aaaagaugggaaacuuuagcacc

SEQ ID NO: 1984 - RNA, 23 nt, Artificial Sequence
  source: /note="Description of Artificial Sequence: Synthetic oligonucleotide"
acaaagaugggaaacuuuagcac

SEQ ID NO: 1985 - RNA, 23 nt, Artificial Sequence
  source: /note="Description of Artificial Sequence: Synthetic oligonucleotide"
aacaaagaugggaaacuuuagca

SEQ ID NO: 1986 - RNA, 23 nt, Artificial Sequence
  source: /note="Description of Artificial Sequence: Synthetic oligonucleotide"
acacaaagaugggaaacuuuagc

SEQ ID NO: 1987 - RNA, 23 nt, Artificial Sequence
  source: /note="Description of Artificial Sequence: Synthetic oligonucleotide"
augcacaaagaugggaaacuuua

SEQ ID NO: 1988 - RNA, 23 nt, Artificial Sequence
  source: /note="Description of Artificial Sequence: Synthetic oligonucleotide"
auaaaaccaacucagcucagagg

SEQ ID NO: 1989 - RNA, 23 nt, Artificial Sequence
  source: /note="Description of Artificial Sequence: Synthetic oligonucleotide"
aauaaaaccaacucagcucagag

SEQ ID NO: 1990 - RNA, 23 nt, Artificial Sequence
  source: /note="Description of Artificial Sequence: Synthetic oligonucleotide"
acauaaaaccaacucagcucaga

SEQ ID NO: 1991 - RNA, 23 nt, Artificial Sequence
  source: /note="Description of Artificial Sequence: Synthetic oligonucleotide"
aucauaaaaccaacucagcucag

SEQ ID NO: 1992 - RNA, 23 nt, Artificial Sequence
  source: /note="Description of Artificial Sequence: Synthetic oligonucleotide"
auucauaaaaccaacucagcuca

SEQ ID NO: 1993 - RNA, 23 nt, Artificial Sequence
  source: /note="Description of Artificial Sequence: Synthetic oligonucleotide"
agcuuuucauaaaaccaacucag

SEQ ID NO: 1994 - RNA, 23 nt, Artificial Sequence
  source: /note="Description of Artificial Sequence: Synthetic oligonucleotide"
aagcuuuucauaaaaccaacuca

SEQ ID NO: 1995 - RNA, 23 nt, Artificial Sequence
  source: /note="Description of Artificial Sequence: Synthetic oligonucleotide"
auagcuuuucauaaaaccaacuc

SEQ ID NO: 1996 - RNA, 23 nt, Artificial Sequence
  source: /note="Description of Artificial Sequence: Synthetic oligonucleotide"
acuuccuagcuuuucauaaaacc

SEQ ID NO: 1997 - RNA, 23 nt, Artificial Sequence
  source: /note="Description of Artificial Sequence: Synthetic oligonucleotide"
aaagguugcuuccuagcuuuuca

SEQ ID NO: 1998 - RNA, 23 nt, Artificial Sequence
  source: /note="Description of Artificial Sequence: Synthetic oligonucleotide"
acgaaagguugcuuccuagcuuu

SEQ ID NO: 1999 - RNA, 23 nt, Artificial Sequence
  source: /note="Description of Artificial Sequence: Synthetic oligonucleotide"
agcgaaagguugcuuccuagcuu

SEQ ID NO: 2000 - RNA, 23 nt, Artificial Sequence
  source: /note="Description of Artificial Sequence: Synthetic oligonucleotide"
aaggcgaaagguugcuuccuagc

SEQ ID NO: 2001 - RNA, 23 nt, Artificial Sequence
  source: /note="Description of Artificial Sequence: Synthetic oligonucleotide"
aguauuagaguuaagugcuggac

SEQ ID NO: 2002 - RNA, 23 nt, Artificial Sequence
  source: /note="Description of Artificial Sequence: Synthetic oligonucleotide"
auguauuagaguuaagugcugga

SEQ ID NO: 2003 - RNA, 23 nt, Artificial Sequence
  source: /note="Description of Artificial Sequence: Synthetic oligonucleotide"
aauguauuagaguuaagugcugg

SEQ ID NO: 2004 - RNA, 23 nt, Artificial Sequence
  source: /note="Description of Artificial Sequence: Synthetic oligonucleotide"
acugauguauuagaguuaagugc

SEQ ID NO: 2005 - RNA, 23 nt, Artificial Sequence
  source: /note="Description of Artificial Sequence: Synthetic oligonucleotide"
acgcaugcugauguauuagaguu

SEQ ID NO: 2006 - RNA, 23 nt, Artificial Sequence
  source: /note="Description of Artificial Sequence: Synthetic oligonucleotide"
aacgcaugcugauguauuagagu

SEQ ID NO: 2007 - RNA, 23 nt, Artificial Sequence
  source: /note="Description of Artificial Sequence: Synthetic oligonucleotide"
aaacgcaugcugauguauuagag

SEQ ID NO: 2008 - RNA, 23 nt, Artificial Sequence
  source: /note="Description of Artificial Sequence: Synthetic oligonucleotide"
auaacgcaugcugauguauuaga

SEQ ID NO: 2009 - RNA, 23 nt, Artificial Sequence
  source: /note="Description of Artificial Sequence: Synthetic oligonucleotide"
aaauuaacgcaugcugauguauu

SEQ ID NO: 2010 - RNA, 23 nt, Artificial Sequence
  source: /note="Description of Artificial Sequence: Synthetic oligonucleotide"
agaauuaacgcaugcugauguau

SEQ ID NO: 2011 - RNA, 23 nt, Artificial Sequence
  source: /note="Description of Artificial Sequence: Synthetic oligonucleotide"
augaauuaacgcaugcugaugua

SEQ ID NO: 2012 - RNA, 23 nt, Artificial Sequence
  source: /note="Description of Artificial Sequence: Synthetic oligonucleotide"
agcugaauuaacgcaugcugaug

SEQ ID NO: 2013 - RNA, 23 nt, Artificial Sequence
  source: /note="Description of Artificial Sequence: Synthetic oligonucleotide"
acagcugaauuaacgcaugcuga

SEQ ID NO: 2014 - RNA, 23 nt, Artificial Sequence
  source: /note="Description of Artificial Sequence: Synthetic oligonucleotide"
acgaaacagucaguaagggaccc

SEQ ID NO: 2015 - RNA, 23 nt, Artificial Sequence
  source: /note="Description of Artificial Sequence: Synthetic oligonucleotide"
aacgaaacagucaguaagggacc

SEQ ID NO: 2016 - RNA, 23 nt, Artificial Sequence
  source: /note="Description of Artificial Sequence: Synthetic oligonucleotide"
acacgaaacagucaguaagggac

SEQ ID NO: 2017 - RNA, 23 nt, Artificial Sequence
  source: /note="Description of Artificial Sequence: Synthetic oligonucleotide"
accacgaaacagucaguaaggga

SEQ ID NO: 2018 - RNA, 23 nt, Artificial Sequence
  source: /note="Description of Artificial Sequence: Synthetic oligonucleotide"
acuaagaaccucaugcuggaaca

SEQ ID NO: 2019 - RNA, 23 nt, Artificial Sequence
  source: /note="Description of Artificial Sequence: Synthetic oligonucleotide"
auucuaagaaccucaugcuggaa

SEQ ID NO: 2020 - RNA, 23 nt, Artificial Sequence
  source: /note="Description of Artificial Sequence: Synthetic oligonucleotide"
aauucuaagaaccucaugcugga

SEQ ID NO: 2021 - RNA, 23 nt, Artificial Sequence
  source: /note="Description of Artificial Sequence: Synthetic oligonucleotide"
acauucuaagaaccucaugcugg

SEQ ID NO: 2022 - RNA, 23 nt, Artificial Sequence
  source: /note="Description of Artificial Sequence: Synthetic oligonucleotide"
agucauucuaagaaccucaugcu

SEQ ID NO: 2023 - RNA, 23 nt, Artificial Sequence
  source: /note="Description of Artificial Sequence: Synthetic oligonucleotide"
aaacaccugucauucuaagaacc

SEQ ID NO: 2024 - RNA, 23 nt, Artificial Sequence
  source: /note="Description of Artificial Sequence: Synthetic oligonucleotide"
agguuaucaucuuugcagaccac

SEQ ID NO: 2025 - RNA, 23 nt, Artificial Sequence
  source: /note="Description of Artificial Sequence: Synthetic oligonucleotide"
aagguuaucaucuuugcagacca

SEQ ID NO: 2026 - RNA, 23 nt, Artificial Sequence
  source: /note="Description of Artificial Sequence: Synthetic oligonucleotide"
aaagguuaucaucuuugcagacc

SEQ ID NO: 2027 - RNA, 23 nt, Artificial Sequence
  source: /note="Description of Artificial Sequence: Synthetic oligonucleotide"
acaagguuaucaucuuugcagac

SEQ ID NO: 2028 - RNA, 23 nt, Artificial Sequence
  source: /note="Description of Artificial Sequence: Synthetic oligonucleotide"
aagucaagguuaucaucuuugca

SEQ ID NO: 2029 - RNA, 23 nt, Artificial Sequence
  source: /note="Description of Artificial Sequence: Synthetic oligonucleotide"
aguuuuuaguagucaagguuauc

SEQ ID NO: 2030 - RNA, 23 nt, Artificial Sequence
  source: /note="Description of Artificial Sequence: Synthetic oligonucleotide"
acguuuuuaguagucaagguuau

SEQ ID NO: 2031 - RNA, 23 nt, Artificial Sequence
  source: /note="Description of Artificial Sequence: Synthetic oligonucleotide"
aacguuuuuaguagucaagguua

SEQ ID NO: 2032 - RNA, 23 nt, Artificial Sequence
  source: /note="Description of Artificial Sequence: Synthetic oligonucleotide"
agacguuuuuaguagucaagguu

SEQ ID NO: 2033 - RNA, 23 nt, Artificial Sequence
  source: /note="Description of Artificial Sequence: Synthetic oligonucleotide"
aagacguuuuuaguagucaaggu

SEQ ID NO: 2034 - RNA, 23 nt, Artificial Sequence
  source: /note="Description of Artificial Sequence: Synthetic oligonucleotide"
agagacguuuuuaguagucaagg

SEQ ID NO: 2035 - RNA, 23 nt, Artificial Sequence
  source: /note="Description of Artificial Sequence: Synthetic oligonucleotide"
aagauuaucaucuuguuaccccc

SEQ ID NO: 2036 - RNA, 23 nt, Artificial Sequence
  source: /note="Description of Artificial Sequence: Synthetic oligonucleotide"
auagauuaucaucuuguuacccc

SEQ ID NO: 2037 - RNA, 23 nt, Artificial Sequence
  source: /note="Description of Artificial Sequence: Synthetic oligonucleotide"
aguagauuaucaucuuguuaccc

SEQ ID NO: 2038 - RNA, 23 nt, Artificial Sequence
  source: /note="Description of Artificial Sequence: Synthetic oligonucleotide"
aaguagauuaucaucuuguuacc

SEQ ID NO: 2039 - RNA, 23 nt, Artificial Sequence
  source: /note="Description of Artificial Sequence: Synthetic oligonucleotide"
aaaguagauuaucaucuuguuac

SEQ ID NO: 2040 - RNA, 23 nt, Artificial Sequence
  source: /note="Description of Artificial Sequence: Synthetic oligonucleotide"
agugaaaaagguguucuaaaauu

SEQ ID NO: 2041 - RNA, 23 nt, Artificial Sequence
  source: /note="Description of Artificial Sequence: Synthetic oligonucleotide"
auaguuaggugaaaaagguguuc

SEQ ID NO: 2042 - RNA, 23 nt, Artificial Sequence
  source: /note="Description of Artificial Sequence: Synthetic oligonucleotide"
auuaguuaggugaaaaagguguu

SEQ ID NO: 2043 - RNA, 23 nt, Artificial Sequence
  source: /note="Description of Artificial Sequence: Synthetic oligonucleotide"
aauuuuaguuaggugaaaaaggu

SEQ ID NO: 2044 - RNA, 23 nt, Artificial Sequence
  source: /note="Description of Artificial Sequence: Synthetic oligonucleotide"
auauuuuaguuaggugaaaaagg

SEQ ID NO: 2045 - RNA, 23 nt, Artificial Sequence
  source: /note="Description of Artificial Sequence: Synthetic oligonucleotide"
auuauuuuaguuaggugaaaaag

SEQ ID NO: 2046 - RNA, 23 nt, Artificial Sequence
  source: /note="Description of Artificial Sequence: Synthetic oligonucleotide"
aauuauuuuaguuaggugaaaaa

SEQ ID NO: 2047 - RNA, 23 nt, Artificial Sequence
  source: /note="Description of Artificial Sequence: Synthetic oligonucleotide"
acauuauuuuaguuaggugaaaa

SEQ ID NO: 2048 - RNA, 23 nt, Artificial Sequence
  source: /note="Description of Artificial Sequence: Synthetic oligonucleotide"
aacauuauuuuaguuaggugaaa

SEQ ID NO: 2049 - RNA, 23 nt, Artificial Sequence
  source: /note="Description of Artificial Sequence: Synthetic oligonucleotide"
aaacauuauuuuaguuaggugaa

SEQ ID NO: 2050 - RNA, 23 nt, Artificial Sequence
  source: /note="Description of Artificial Sequence: Synthetic oligonucleotide"
aguaacaacgcuuccuuacauuu

SEQ ID NO: 2051 - RNA, 23 nt, Artificial Sequence
  source: /note="Description of Artificial Sequence: Synthetic oligonucleotide"
auucaacagguaacaacgcuucc

SEQ ID NO: 2052 - RNA, 23 nt, Artificial Sequence
  source: /note="Description of Artificial Sequence: Synthetic oligonucleotide"
aauucaacagguaacaacgcuuc

SEQ ID NO: 2053 - RNA, 23 nt, Artificial Sequence
  source: /note="Description of Artificial Sequence: Synthetic oligonucleotide"
aaaaauucaacagguaacaacgc

SEQ ID NO: 2054 - RNA, 23 nt, Artificial Sequence
  source: /note="Description of Artificial Sequence: Synthetic oligonucleotide"
acaaaauucaacagguaacaacg

SEQ ID NO: 2055 - RNA, 23 nt, Artificial Sequence
  source: /note="Description of Artificial Sequence: Synthetic oligonucleotide"
aacaaaauucaacagguaacaac

SEQ ID NO: 2056 - RNA, 23 nt, Artificial Sequence
  source: /note="Description of Artificial Sequence: Synthetic oligonucleotide"
aauacaaaauucaacagguaaca

SEQ ID NO: 2057 - RNA, 23 nt, Artificial Sequence
  source: /note="Description of Artificial Sequence: Synthetic oligonucleotide"
aaauacaaaauucaacagguaac

SEQ ID NO: 2058 - RNA, 23 nt, Artificial Sequence
  source: /note="Description of Artificial Sequence: Synthetic oligonucleotide"
auaauacaaaauucaacagguaa

SEQ ID NO: 2059 - RNA, 23 nt, Artificial Sequence
  source: /note="Description of Artificial Sequence: Synthetic oligonucleotide"
acauaauacaaaauucaacaggu

SEQ ID NO: 2060 - RNA, 23 nt, Artificial Sequence
  source: /note="Description of Artificial Sequence: Synthetic oligonucleotide"
acacauaauacaaaauucaacag

SEQ ID NO: 2061 - RNA, 23 nt, Artificial Sequence
  source: /note="Description of Artificial Sequence: Synthetic oligonucleotide"
aauucuacuaacaucucacugau

SEQ ID NO: 2062 - RNA, 23 nt, Artificial Sequence
  source: /note="Description of Artificial Sequence: Synthetic oligonucleotide"
agcuuauucuacuaacaucucac

SEQ ID NO: 2063 - RNA, 23 nt, Artificial Sequence
  source: /note="Description of Artificial Sequence: Synthetic oligonucleotide"
auuuuaaggcuuauucuacuaac

SEQ ID NO: 2064 - RNA, 23 nt, Artificial Sequence
  source: /note="Description of Artificial Sequence: Synthetic oligonucleotide"
augaaauggugcaaucucagcuc

SEQ ID NO: 2065 - RNA, 23 nt, Artificial Sequence
  source: /note="Description of Artificial Sequence: Synthetic oligonucleotide"
aaugaaauggugcaaucucagcu

SEQ ID NO: 2066 - RNA, 23 nt, Artificial Sequence
  source: /note="Description of Artificial Sequence: Synthetic oligonucleotide"
aaaugaaauggugcaaucucagc

SEQ ID NO: 2067 - RNA, 23 nt, Artificial Sequence
  source: /note="Description of Artificial Sequence: Synthetic oligonucleotide"
aggaaugaaauggugcaaucuca

SEQ ID NO: 2068 - RNA, 23 nt, Artificial Sequence
  source: /note="Description of Artificial Sequence: Synthetic oligonucleotide"
agcacacuagauuauuuuguuuu

SEQ ID NO: 2069 - RNA, 23 nt, Artificial Sequence
  source: /note="Description of Artificial Sequence: Synthetic oligonucleotide"
acugcacacuagauuauuuuguu

SEQ ID NO: 2070 - RNA, 23 nt, Artificial Sequence
  source: /note="Description of Artificial Sequence: Synthetic oligonucleotide"
aagaaaauaagccagguucaagu

SEQ ID NO: 2071 - RNA, 23 nt, Artificial Sequence
  source: /note="Description of Artificial Sequence: Synthetic oligonucleotide"
aagaaacucacugaccauguggg

SEQ ID NO: 2072 - RNA, 21 nt, Artificial Sequence
  source: /note="Description of Artificial Sequence: Synthetic oligonucleotide"
guccucucagaucuugugcgu

SEQ ID NO: 2073 - RNA, 21 nt, Artificial Sequence
  source: /note="Description of Artificial Sequence: Synthetic oligonucleotide"
cauccauccuucaacuuaagu

SEQ ID NO: 2074 - RNA, 21 nt, Artificial Sequence
  source: /note="Description of Artificial Sequence: Synthetic oligonucleotide"
auccauccuucaacuuaagcu

SEQ ID NO: 2075 - RNA, 21 nt, Artificial Sequence
  source: /note="Description of Artificial Sequence: Synthetic oligonucleotide"
uccauccuucaacuuaagcau

SEQ ID NO: 2076 - RNA, 21 nt, Artificial Sequence
  source: /note="Description of Artificial Sequence: Synthetic oligonucleotide"
uuaagcaaguuccuccgacau

SEQ ID NO: 2077 - RNA, 21 nt, Artificial Sequence
  source: /note="Description of Artificial Sequence: Synthetic oligonucleotide"
gcaaaauaggcaucucucuuu

SEQ ID NO: 2078 - RNA, 21 nt, Artificial Sequence
  source: /note="Description of Artificial Sequence: Synthetic oligonucleotide"
aaaauaggcaucucucuuacu

SEQ ID NO: 2079 - RNA, 21 nt, Artificial Sequence
  source: /note="Description of Artificial Sequence: Synthetic oligonucleotide"
aaauaggcaucucucuuaccu

SEQ ID NO: 2080 - RNA, 21 nt, Artificial Sequence
  source: /note="Description of Artificial Sequence: Synthetic oligonucleotide"
auaggcaucucucuuaccagu

SEQ ID NO: 2081 - RNA, 21 nt, Artificial Sequence
  source: /note="Description of Artificial Sequence: Synthetic oligonucleotide"
aucucucuuaccagagugucu

SEQ ID NO: 2082 - RNA, 21 nt, Artificial Sequence
  source: /note="Description of Artificial Sequence: Synthetic oligonucleotide"
acuuucgguccaaagacgaau

SEQ ID NO: 2083 - RNA, 21 nt, Artificial Sequence
  source: /note="Description of Artificial Sequence: Synthetic oligonucleotide"
uuucgguccaaagacgaaguu

SEQ ID NO: 2084 - RNA, 21 nt, Artificial Sequence
  source: /note="Description of Artificial Sequence: Synthetic oligonucleotide"
cgguccaaagacgaagucguu

SEQ ID NO: 2085 - RNA, 21 nt, Artificial Sequence
  source: /note="Description of Artificial Sequence: Synthetic oligonucleotide"
gguccaaagacgaagucgugu

SEQ ID NO: 2086 - RNA, 21 nt, Artificial Sequence
  source: /note="Description of Artificial Sequence: Synthetic oligonucleotide"
uugguauguuccugcuucauu

SEQ ID NO: 2087 - RNA, 21 nt, Artificial Sequence
  source: /note="Description of Artificial Sequence: Synthetic oligonucleotide"
ugacaacguacccuucauugu

SEQ ID NO: 2088 - RNA, 21 nt, Artificial Sequence
  source: /note="Description of Artificial Sequence: Synthetic oligonucleotide"
gacaacguacccuucauugau

SEQ ID NO: 2089 - RNA, 21 nt, Artificial Sequence
  source: /note="Description of Artificial Sequence: Synthetic oligonucleotide"
acaacguacccuucauugauu

SEQ ID NO: 2090 - RNA, 21 nt, Artificial Sequence
  source: /note="Description of Artificial Sequence: Synthetic oligonucleotide"
caacguacccuucauugaugu

SEQ ID NO: 2091 - RNA, 21 nt, Artificial Sequence
  source: /note="Description of Artificial Sequence: Synthetic oligonucleotide"
aacguacccuucauugaugcu

SEQ ID NO: 2092 - RNA, 21 nt, Artificial Sequence
  source: /note="Description of Artificial Sequence: Synthetic oligonucleotide"
uaaagucaaguccacgaacuu

SEQ ID NO: 2093 - RNA, 21 nt, Artificial Sequence
  source: /note="Description of Artificial Sequence: Synthetic oligonucleotide"
aaagucaaguccacgaacuuu

SEQ ID NO: 2094 - RNA, 21 nt, Artificial Sequence
  source: /note="Description of Artificial Sequence: Synthetic oligonucleotide"
uccacgaacuuucuucauguu

SEQ ID NO: 2095 - RNA, 21 nt, Artificial Sequence
  source: /note="Description of Artificial Sequence: Synthetic oligonucleotide"
ccacgaacuuucuucaugugu

SEQ ID NO: 2096 - RNA, 21 nt, Artificial Sequence
  source: /note="Description of Artificial Sequence: Synthetic oligonucleotide"
cacgaacuuucuucauguggu

SEQ ID NO: 2097 - RNA, 21 nt, Artificial Sequence
  source: /note="Description of Artificial Sequence: Synthetic oligonucleotide"
acgaacuuucuucauguggau

SEQ ID NO: 2098 - RNA, 21 nt, Artificial Sequence
  source: /note="Description of Artificial Sequence: Synthetic oligonucleotide"
cgaacuuucuucauguggacu

SEQ ID NO: 2099 - RNA, 21 nt, Artificial Sequence
  source: /note="Description of Artificial Sequence: Synthetic oligonucleotide"
uucucucgagagcuuuugucu

SEQ ID NO: 2100 - RNA, 21 nt, Artificial Sequence
  source: /note="Description of Artificial Sequence: Synthetic oligonucleotide"
ugcuacccauuaggauaaugu

SEQ ID NO: 2101 - RNA, 21 nt, Artificial Sequence
  source: /note="Description of Artificial Sequence: Synthetic oligonucleotide"
gcuacccauuaggauaauguu

SEQ ID NO: 2102 - RNA, 21 nt, Artificial Sequence
  source: /note="Description of Artificial Sequence: Synthetic oligonucleotide"
cuacccauuaggauaaugucu

SEQ ID NO: 2103 - RNA, 21 nt, Artificial Sequence
  source: /note="Description of Artificial Sequence: Synthetic oligonucleotide"
uacccauuaggauaaugucuu

SEQ ID NO: 2104 - RNA, 21 nt, Artificial Sequence
  source: /note="Description of Artificial Sequence: Synthetic oligonucleotide"
acccauuaggauaaugucuuu

SEQ ID NO: 2105 - RNA, 21 nt, Artificial Sequence
  source: /note="Description of Artificial Sequence: Synthetic oligonucleotide"
uuaggauaaugucuuauguau

SEQ ID NO: 2106 - RNA, 21 nt, Artificial Sequence
  source: /note="Description of Artificial Sequence: Synthetic oligonucleotide"
uaggauaaugucuuauguaau

SEQ ID NO: 2107 - RNA, 21 nt, Artificial Sequence
  source: /note="Description of Artificial Sequence: Synthetic oligonucleotide"
ucacagguguucacucgaguu

SEQ ID NO: 2108 - RNA, 21 nt, Artificial Sequence
  source: /note="Description of Artificial Sequence: Synthetic oligonucleotide"
cuugggcaauaaaguaccugu

SEQ ID NO: 2109 - RNA, 21 nt, Artificial Sequence
  source: /note="Description of Artificial Sequence: Synthetic oligonucleotide"
uucccaguuuuucacuagagu

SEQ ID NO: 2110 - RNA, 21 nt, Artificial Sequence
  source: /note="Description of Artificial Sequence: Synthetic oligonucleotide"
ggcgagucuagcagauucuuu

SEQ ID NO: 2111 - RNA, 21 nt, Artificial Sequence
  source: /note="Description of Artificial Sequence: Synthetic oligonucleotide"
gcgagucuagcagauucuuuu

SEQ ID NO: 2112 - RNA, 21 nt, Artificial Sequence
  source: /note="Description of Artificial Sequence: Synthetic oligonucleotide"
cgagucuagcagauucuuucu

SEQ ID NO: 2113 - RNA, 21 nt, Artificial Sequence
  source: /note="Description of Artificial Sequence: Synthetic oligonucleotide"
gagucuagcagauucuuucau

SEQ ID NO: 2114 - RNA, 21 nt, Artificial Sequence
  source: /note="Description of Artificial Sequence: Synthetic oligonucleotide"
agucuagcagauucuuucagu

SEQ ID NO: 2115 - RNA, 21 nt, Artificial Sequence
  source: /note="Description of Artificial Sequence: Synthetic oligonucleotide"
gucuagcagauucuuucagau

SEQ ID NO: 2116 - RNA, 21 nt, Artificial Sequence
  source: /note="Description of Artificial Sequence: Synthetic oligonucleotide"
ucuagcagauucuuucagagu

SEQ ID NO: 2117 - RNA, 21 nt, Artificial Sequence
  source: /note="Description of Artificial Sequence: Synthetic oligonucleotide"
ugcuaaaguuucccaucuuuu

SEQ ID NO: 2118 - RNA, 21 nt, Artificial Sequence
  source: /note="Description of Artificial Sequence: Synthetic oligonucleotide"
gcuaaaguuucccaucuuugu

SEQ ID NO: 2119 - RNA, 21 nt, Artificial Sequence
  source: /note="Description of Artificial Sequence: Synthetic oligonucleotide"
cuaaaguuucccaucuuuguu

SEQ ID NO: 2120 - RNA, 21 nt, Artificial Sequence
  source: /note="Description of Artificial Sequence: Synthetic oligonucleotide"
uaaaguuucccaucuuugugu

SEQ ID NO: 2121 - RNA, 21 nt, Artificial Sequence
  source: /note="Description of Artificial Sequence: Synthetic oligonucleotide"
aaguuucccaucuuugugcau

SEQ ID NO: 2122 - RNA, 21 nt, Artificial Sequence
  source: /note="Description of Artificial Sequence: Synthetic oligonucleotide"
ucugagcugaguugguuuuau

SEQ ID NO: 2123 - RNA, 21 nt, Artificial Sequence
  source: /note="Description of Artificial Sequence: Synthetic oligonucleotide"
cugagcugaguugguuuuauu

SEQ ID NO: 2124 - RNA, 21 nt, Artificial Sequence
  source: /note="Description of Artificial Sequence: Synthetic oligonucleotide"
ugagcugaguugguuuuaugu

SEQ ID NO: 2125 - RNA, 21 nt, Artificial Sequence
  source: /note="Description of Artificial Sequence: Synthetic oligonucleotide"
gagcugaguugguuuuaugau

SEQ ID NO: 2126 - RNA, 21 nt, Artificial Sequence
  source: /note="Description of Artificial Sequence: Synthetic oligonucleotide"
agcugaguugguuuuaugaau

SEQ ID NO: 2127 - RNA, 21 nt, Artificial Sequence
  source: /note="Description of Artificial Sequence: Synthetic oligonucleotide"
gaguugguuuuaugaaaagcu

SEQ ID NO: 2128 - RNA, 21 nt, Artificial Sequence
  source: /note="Description of Artificial Sequence: Synthetic oligonucleotide"
aguugguuuuaugaaaagcuu

SEQ ID NO: 2129 - RNA, 21 nt, Artificial Sequence
  source: /note="Description of Artificial Sequence: Synthetic oligonucleotide"
guugguuuuaugaaaagcuau

SEQ ID NO: 2130 - RNA, 21 nt, Artificial Sequence
  source: /note="Description of Artificial Sequence: Synthetic oligonucleotide"
uuuuaugaaaagcuaggaagu

SEQ ID NO: 2131 - RNA, 21 nt, Artificial Sequence
  source: /note="Description of Artificial Sequence: Synthetic oligonucleotide"
aaaagcuaggaagcaaccuuu

SEQ ID NO: 2132 - RNA, 21 nt, Artificial Sequence
  source: /note="Description of Artificial Sequence: Synthetic oligonucleotide"
agcuaggaagcaaccuuucgu

SEQ ID NO: 2133 - RNA, 21 nt, Artificial Sequence
  source: /note="Description of Artificial Sequence: Synthetic oligonucleotide"
gcuaggaagcaaccuuucgcu

SEQ ID NO: 2134 - RNA, 21 nt, Artificial Sequence
  source: /note="Description of Artificial Sequence: Synthetic oligonucleotide"
uaggaagcaaccuuucgccuu

SEQ ID NO: 2135 - RNA, 21 nt, Artificial Sequence
  source: /note="Description of Artificial Sequence: Synthetic oligonucleotide"
ccagcacuuaacucuaauacu

SEQ ID NO: 2136 - RNA, 21 nt, Artificial Sequence
  source: /note="Description of Artificial Sequence: Synthetic oligonucleotide"
cagcacuuaacucuaauacau

SEQ ID NO: 2137 - RNA, 21 nt, Artificial Sequence
  source: /note="Description of Artificial Sequence: Synthetic oligonucleotide"
agcacuuaacucuaauacauu

SEQ ID NO: 2138 - RNA, 21 nt, Artificial Sequence
  source: /note="Description of Artificial Sequence: Synthetic oligonucleotide"
acuuaacucuaauacaucagu

SEQ ID NO: 2139 - RNA, 21 nt, Artificial Sequence
  source: /note="Description of Artificial Sequence: Synthetic oligonucleotide"
cucuaauacaucagcaugcgu

SEQ ID NO: 2140 - RNA, 21 nt, Artificial Sequence
  source: /note="Description of Artificial Sequence: Synthetic oligonucleotide"
ucuaauacaucagcaugcguu

SEQ ID NO: 2141 - RNA, 21 nt, Artificial Sequence
  source: /note="Description of Artificial Sequence: Synthetic oligonucleotide"
cuaauacaucagcaugcguuu

SEQ ID NO: 2142 - RNA, 21 nt, Artificial Sequence
  source: /note="Description of Artificial Sequence: Synthetic oligonucleotide"
uaauacaucagcaugcguuau

SEQ ID NO: 2143 - RNA, 21 nt, Artificial Sequence
  source: /note="Description of Artificial Sequence: Synthetic oligonucleotide"
uacaucagcaugcguuaauuu

SEQ ID NO: 2144 - RNA, 21 nt, Artificial Sequence
  source: /note="Description of Artificial Sequence: Synthetic oligonucleotide"
acaucagcaugcguuaauucu

SEQ ID NO: 2145 - RNA, 21 nt, Artificial Sequence
  source: /note="Description of Artificial Sequence: Synthetic oligonucleotide"
caucagcaugcguuaauucau

SEQ ID NO: 2146 - RNA, 21 nt, Artificial Sequence
  source: /note="Description of Artificial Sequence: Synthetic oligonucleotide"
ucagcaugcguuaauucagcu

SEQ ID NO: 2147 - RNA, 21 nt, Artificial Sequence
  source: /note="Description of Artificial Sequence: Synthetic oligonucleotide"
agcaugcguuaauucagcugu

SEQ ID NO: 2148 - RNA, 21 nt, Artificial Sequence
  source: /note="Description of Artificial Sequence: Synthetic oligonucleotide"
gucccuuacugacuguuucgu

SEQ ID NO: 2149 - RNA, 21 nt, Artificial Sequence
  source: /note="Description of Artificial Sequence: Synthetic oligonucleotide"
ucccuuacugacuguuucguu

SEQ ID NO: 2150 - RNA, 21 nt, Artificial Sequence
  source: /note="Description of Artificial Sequence: Synthetic oligonucleotide"
cccuuacugacuguuucgugu

SEQ ID NO: 2151 - RNA, 21 nt, Artificial Sequence
  source: /note="Description of Artificial Sequence: Synthetic oligonucleotide"
ccuuacugacuguuucguggu

SEQ ID NO: 2152 - RNA, 21 nt, Artificial Sequence
  source: /note="Description of Artificial Sequence: Synthetic oligonucleotide"
uuccagcaugagguucuuagu

SEQ ID NO: 2153 - RNA, 21 nt, Artificial Sequence
  source: /note="Description of Artificial Sequence: Synthetic oligonucleotide"
ccagcaugagguucuuagaau

SEQ ID NO: 2154 - RNA, 21 nt, Artificial Sequence
  source: /note="Description of Artificial Sequence: Synthetic oligonucleotide"
cagcaugagguucuuagaauu

SEQ ID NO: 2155 - RNA, 21 nt, Artificial Sequence
  source: /note="Description of Artificial Sequence: Synthetic oligonucleotide"
agcaugagguucuuagaaugu

SEQ ID NO: 2156 - RNA, 21 nt, Artificial Sequence
  source: /note="Description of Artificial Sequence: Synthetic oligonucleotide"
caugagguucuuagaaugacu

SEQ ID NO: 2157 - RNA, 21 nt, Artificial Sequence
  source: /note="Description of Artificial Sequence: Synthetic oligonucleotide"
uucuuagaaugacagguguuu

SEQ ID NO: 2158 - RNA, 21 nt, Artificial Sequence
  source: /note="Description of Artificial Sequence: Synthetic oligonucleotide"
ggucugcaaagaugauaaccu

SEQ ID NO: 2159 - RNA, 21 nt, Artificial Sequence
  source: /note="Description of Artificial Sequence: Synthetic oligonucleotide"
gucugcaaagaugauaaccuu

SEQ ID NO: 2160 - RNA, 21 nt, Artificial Sequence
  source: /note="Description of Artificial Sequence: Synthetic oligonucleotide"
ucugcaaagaugauaaccuuu

SEQ ID NO: 2161 - RNA, 21 nt, Artificial Sequence
  source: /note="Description of Artificial Sequence: Synthetic oligonucleotide"
cugcaaagaugauaaccuugu

SEQ ID NO: 2162 - RNA, 21 nt, Artificial Sequence
  source: /note="Description of Artificial Sequence: Synthetic oligonucleotide"
caaagaugauaaccuugacuu

SEQ ID NO: 2163 - RNA, 21 nt, Artificial Sequence
  source: /note="Description of Artificial Sequence: Synthetic oligonucleotide"
uaaccuugacuacuaaaaacu

SEQ ID NO: 2164 - RNA, 21 nt, Artificial Sequence
  source: /note="Description of Artificial Sequence: Synthetic oligonucleotide"
aaccuugacuacuaaaaacgu

SEQ ID NO: 2165 - RNA, 21 nt, Artificial Sequence
  source: /note="Description of Artificial Sequence: Synthetic oligonucleotide"
accuugacuacuaaaaacguu

SEQ ID NO: 2166 - RNA, 21 nt, Artificial Sequence
  source: /note="Description of Artificial Sequence: Synthetic oligonucleotide"
ccuugacuacuaaaaacgucu

SEQ ID NO: 2167 - RNA, 21 nt, Artificial Sequence
  source: /note="Description of Artificial Sequence: Synthetic oligonucleotide"
cuugacuacuaaaaacgucuu

SEQ ID NO: 2168 - RNA, 21 nt, Artificial Sequence
  source: /note="Description of Artificial Sequence: Synthetic oligonucleotide"
uugacuacuaaaaacgucucu

SEQ ID NO: 2169 - RNA, 21 nt, Artificial Sequence
  source: /note="Description of Artificial Sequence: Synthetic oligonucleotide"
ggguaacaagaugauaaucuu

SEQ ID NO: 2170 - RNA, 21 nt, Artificial Sequence
  source: /note="Description of Artificial Sequence: Synthetic oligonucleotide"
gguaacaagaugauaaucuau

SEQ ID NO: 2171 - RNA, 21 nt, Artificial Sequence
  source: /note="Description of Artificial Sequence: Synthetic oligonucleotide"
guaacaagaugauaaucuacu

SEQ ID NO: 2172 - RNA, 21 nt, Artificial Sequence
  source: /note="Description of Artificial Sequence: Synthetic oligonucleotide"
uaacaagaugauaaucuacuu

SEQ ID NO: 2173 - RNA, 21 nt, Artificial Sequence
  source: /note="Description of Artificial Sequence: Synthetic oligonucleotide"
aacaagaugauaaucuacuuu

SEQ ID NO: 2174 - RNA, 21 nt, Artificial Sequence
  source: /note="Description of Artificial Sequence: Synthetic oligonucleotide"
uuuuagaacaccuuuuucacu

SEQ ID NO: 2175 - RNA, 21 nt, Artificial Sequence
  source: /note="Description of Artificial Sequence: Synthetic oligonucleotide"
acaccuuuuucaccuaacuau

SEQ ID NO: 2176 - RNA, 21 nt, Artificial Sequence
  source: /note="Description of Artificial Sequence: Synthetic oligonucleotide"
caccuuuuucaccuaacuaau

SEQ ID NO: 2177 - RNA, 21 nt, Artificial Sequence
  source: /note="Description of Artificial Sequence: Synthetic oligonucleotide"
cuuuuucaccuaacuaaaauu

SEQ ID NO: 2178 - RNA, 21 nt, Artificial Sequence
  source: /note="Description of Artificial Sequence: Synthetic oligonucleotide"
uuuuucaccuaacuaaaauau

SEQ ID NO: 2179 - RNA, 21 nt, Artificial Sequence
  source: /note="Description of Artificial Sequence: Synthetic oligonucleotide"
uuuucaccuaacuaaaauaau

SEQ ID NO: 2180 - RNA, 21 nt, Artificial Sequence
  source: /note="Description of Artificial Sequence: Synthetic oligonucleotide"
uuucaccuaacuaaaauaauu

SEQ ID NO: 2181 - RNA, 21 nt, Artificial Sequence
  source: /note="Description of Artificial Sequence: Synthetic oligonucleotide"
uucaccuaacuaaaauaaugu

SEQ ID NO: 2182 - RNA, 21 nt, Artificial Sequence
  source: /note="Description of Artificial Sequence: Synthetic oligonucleotide"
ucaccuaacuaaaauaauguu

SEQ ID NO: 2183 - RNA, 21 nt, Artificial Sequence
  source: /note="Description of Artificial Sequence: Synthetic oligonucleotide"
caccuaacuaaaauaauguuu

SEQ ID NO: 2184 - RNA, 21 nt, Artificial Sequence
  source: /note="Description of Artificial Sequence: Synthetic oligonucleotide"
auguaaggaagcguuguuacu

SEQ ID NO: 2185 - RNA, 21 nt, Artificial Sequence
  source: /note="Description of Artificial Sequence: Synthetic oligonucleotide"
aagcguuguuaccuguugaau

SEQ ID NO: 2186 - RNA, 21 nt, Artificial Sequence
  source: /note="Description of Artificial Sequence: Synthetic oligonucleotide"
agcguuguuaccuguugaauu

SEQ ID NO: 2187 - RNA, 21 nt, Artificial Sequence
  source: /note="Description of Artificial Sequence: Synthetic oligonucleotide"
guuguuaccuguugaauuuuu

SEQ ID NO: 2188 - RNA, 21 nt, Artificial Sequence
  source: /note="Description of Artificial Sequence: Synthetic oligonucleotide"
uuguuaccuguugaauuuugu

SEQ ID NO: 2189 - RNA, 21 nt, Artificial Sequence
  source: /note="Description of Artificial Sequence: Synthetic oligonucleotide"
uguuaccuguugaauuuuguu

SEQ ID NO: 2190 - RNA, 21 nt, Artificial Sequence
  source: /note="Description of Artificial Sequence: Synthetic oligonucleotide"
uuaccuguugaauuuuguauu

SEQ ID NO: 2191 - RNA, 21 nt, Artificial Sequence
  source: /note="Description of Artificial Sequence: Synthetic oligonucleotide"
uaccuguugaauuuuguauuu

SEQ ID NO: 2192 - RNA, 21 nt, Artificial Sequence
  source: /note="Description of Artificial Sequence: Synthetic oligonucleotide"
accuguugaauuuuguauuau

SEQ ID NO: 2193 - RNA, 21 nt, Artificial Sequence
  source: /note="Description of Artificial Sequence: Synthetic oligonucleotide"
cuguugaauuuuguauuaugu

SEQ ID NO: 2194 - RNA, 21 nt, Artificial Sequence
  source: /note="Description of Artificial Sequence: Synthetic oligonucleotide"
guugaauuuuguauuaugugu

SEQ ID NO: 2195 - RNA, 21 nt, Artificial Sequence
  source: /note="Description of Artificial Sequence: Synthetic oligonucleotide"
cagugagauguuaguagaauu

SEQ ID NO: 2196 - RNA, 21 nt, Artificial Sequence
  source: /note="Description of Artificial Sequence: Synthetic oligonucleotide"
gagauguuaguagaauaagcu

SEQ ID NO: 2197 - RNA, 21 nt, Artificial Sequence
  source: /note="Description of Artificial Sequence: Synthetic oligonucleotide"
uaguagaauaagccuuaaaau

SEQ ID NO: 2198 - RNA, 21 nt, Artificial Sequence
  source: /note="Description of Artificial Sequence: Synthetic oligonucleotide"
gcugagauugcaccauuucau

SEQ ID NO: 2199 - RNA, 21 nt, Artificial Sequence
  source: /note="Description of Artificial Sequence: Synthetic oligonucleotide"
cugagauugcaccauuucauu

SEQ ID NO: 2200 - RNA, 21 nt, Artificial Sequence
  source: /note="Description of Artificial Sequence: Synthetic oligonucleotide"
ugagauugcaccauuucauuu

SEQ ID NO: 2201 - RNA, 21 nt, Artificial Sequence
  source: /note="Description of Artificial Sequence: Synthetic oligonucleotide"
agauugcaccauuucauuccu

SEQ ID NO: 2202 - RNA, 21 nt, Artificial Sequence
  source: /note="Description of Artificial Sequence: Synthetic oligonucleotide"
aacaaaauaaucuagugugcu

SEQ ID NO: 2203 - RNA, 21 nt, Artificial Sequence
  source: /note="Description of Artificial Sequence: Synthetic oligonucleotide"
caaaauaaucuagugugcagu

SEQ ID NO: 2204 - RNA, 21 nt, Artificial Sequence
  source: /note="Description of Artificial Sequence: Synthetic oligonucleotide"
uugaaccuggcuuauuuucuu

SEQ ID NO: 2205 - RNA, 21 nt, Artificial Sequence
  source: /note="Description of Artificial Sequence: Synthetic oligonucleotide"
cacauggucagugaguuucuu

SEQ ID NO: 2206 - RNA, 23 nt, Artificial Sequence
  source: /note="Description of Artificial Sequence: Synthetic oligonucleotide"
acgcacaagaucugagaggaccu

SEQ ID NO: 2207 - RNA, 23 nt, Artificial Sequence
  source: /note="Description of Artificial Sequence: Synthetic oligonucleotide"
acuuaaguugaaggauggaugga

SEQ ID NO: 2208 - RNA, 23 nt, Artificial Sequence
  source: /note="Description of Artificial Sequence: Synthetic oligonucleotide"
agcuuaaguugaaggauggaugg

SEQ ID NO: 2209 - RNA, 23 nt, Artificial Sequence
  source: /note="Description of Artificial Sequence: Synthetic oligonucleotide"
augcuuaaguugaaggauggaug

SEQ ID NO: 2210 - RNA, 23 nt, Artificial Sequence
  source: /note="Description of Artificial Sequence: Synthetic oligonucleotide"
augucggaggaacuugcuuaagu

SEQ ID NO: 2211 - RNA, 23 nt, Artificial Sequence
  source: /note="Description of Artificial Sequence: Synthetic oligonucleotide"
aaagagagaugccuauuuugccg

SEQ ID NO: 2212 - RNA, 23 nt, Artificial Sequence
  source: /note="Description of Artificial Sequence: Synthetic oligonucleotide"
aguaagagagaugccuauuuugc

SEQ ID NO: 2213 - RNA, 23 nt, Artificial Sequence
  source: /note="Description of Artificial Sequence: Synthetic oligonucleotide"
agguaagagagaugccuauuuug

SEQ ID NO: 2214 - RNA, 23 nt, Artificial Sequence
  source: /note="Description of Artificial Sequence: Synthetic oligonucleotide"
acugguaagagagaugccuauuu

SEQ ID NO: 2215 - RNA, 23 nt, Artificial Sequence
  source: /note="Description of Artificial Sequence: Synthetic oligonucleotide"
agacacucugguaagagagaugc

SEQ ID NO: 2216 - RNA, 23 nt, Artificial Sequence
  source: /note="Description of Artificial Sequence: Synthetic oligonucleotide"
auucgucuuuggaccgaaaguca

SEQ ID NO: 2217 - RNA, 23 nt, Artificial Sequence
  source: /note="Description of Artificial Sequence: Synthetic oligonucleotide"
aacuucgucuuuggaccgaaagu

SEQ ID NO: 2218 - RNA, 23 nt, Artificial Sequence
  source: /note="Description of Artificial Sequence: Synthetic oligonucleotide"
aacgacuucgucuuuggaccgaa

SEQ ID NO: 2219 - RNA, 23 nt, Artificial Sequence
  source: /note="Description of Artificial Sequence: Synthetic oligonucleotide"
acacgacuucgucuuuggaccga

SEQ ID NO: 2220 - RNA, 23 nt, Artificial Sequence
  source: /note="Description of Artificial Sequence: Synthetic oligonucleotide"
aaugaagcaggaacauaccaagg

SEQ ID NO: 2221 - RNA, 23 nt, Artificial Sequence
  source: /note="Description of Artificial Sequence: Synthetic oligonucleotide"
acaaugaaggguacguugucacu

SEQ ID NO: 2222 - RNA, 23 nt, Artificial Sequence
  source: /note="Description of Artificial Sequence: Synthetic oligonucleotide"
aucaaugaaggguacguugucac

SEQ ID NO: 2223 - RNA, 23 nt, Artificial Sequence
  source: /note="Description of Artificial Sequence: Synthetic oligonucleotide"
aaucaaugaaggguacguuguca

SEQ ID NO: 2224 - RNA, 23 nt, Artificial Sequence
  source: /note="Description of Artificial Sequence: Synthetic oligonucleotide"
acaucaaugaaggguacguuguc

SEQ ID NO: 2225 - RNA, 23 nt, Artificial Sequence
  source: /note="Description of Artificial Sequence: Synthetic oligonucleotide"
agcaucaaugaaggguacguugu

SEQ ID NO: 2226 - RNA, 23 nt, Artificial Sequence
  source: /note="Description of Artificial Sequence: Synthetic oligonucleotide"
aaguucguggacuugacuuuagg

SEQ ID NO: 2227 - RNA, 23 nt, Artificial Sequence
  source: /note="Description of Artificial Sequence: Synthetic oligonucleotide"
aaaguucguggacuugacuuuag

SEQ ID NO: 2228 - RNA, 23 nt, Artificial Sequence
  source: /note="Description of Artificial Sequence: Synthetic oligonucleotide"
aacaugaagaaaguucguggacu

SEQ ID NO: 2229 - RNA, 23 nt, Artificial Sequence
  source: /note="Description of Artificial Sequence: Synthetic oligonucleotide"
acacaugaagaaaguucguggac

SEQ ID NO: 2230 - RNA, 23 nt, Artificial Sequence
  source: /note="Description of Artificial Sequence: Synthetic oligonucleotide"
accacaugaagaaaguucgugga

SEQ ID NO: 2231 - RNA, 23 nt, Artificial Sequence
  source: /note="Description of Artificial Sequence: Synthetic oligonucleotide"
auccacaugaagaaaguucgugg

SEQ ID NO: 2232 - RNA, 23 nt, Artificial Sequence
  source: /note="Description of Artificial Sequence: Synthetic oligonucleotide"
aguccacaugaagaaaguucgug

SEQ ID NO: 2233 - RNA, 23 nt, Artificial Sequence
  source: /note="Description of Artificial Sequence: Synthetic oligonucleotide"
agacaaaagcucucgagagaagg

SEQ ID NO: 2234 - RNA, 23 nt, Artificial Sequence
  source: /note="Description of Artificial Sequence: Synthetic oligonucleotide"
acauuauccuaauggguagcaag

SEQ ID NO: 2235 - RNA, 23 nt, Artificial Sequence
  source: /note="Description of Artificial Sequence: Synthetic oligonucleotide"
aacauuauccuaauggguagcaa

SEQ ID NO: 2236 - RNA, 23 nt, Artificial Sequence
  source: /note="Description of Artificial Sequence: Synthetic oligonucleotide"
agacauuauccuaauggguagca

SEQ ID NO: 2237 - RNA, 23 nt, Artificial Sequence
  source: /note="Description of Artificial Sequence: Synthetic oligonucleotide"
aagacauuauccuaauggguagc

SEQ ID NO: 2238 - RNA, 23 nt, Artificial Sequence
  source: /note="Description of Artificial Sequence: Synthetic oligonucleotide"
aaagacauuauccuaauggguag

SEQ ID NO: 2239 - RNA, 23 nt, Artificial Sequence
  source: /note="Description of Artificial Sequence: Synthetic oligonucleotide"
auacauaagacauuauccuaaug

SEQ ID NO: 2240 - RNA, 23 nt, Artificial Sequence
  source: /note="Description of Artificial Sequence: Synthetic oligonucleotide"
auuacauaagacauuauccuaau

SEQ ID NO: 2241 - RNA, 23 nt, Artificial Sequence
  source: /note="Description of Artificial Sequence: Synthetic oligonucleotide"
aacucgagugaacaccugugagg

SEQ ID NO: 2242 - RNA, 23 nt, Artificial Sequence
  source: /note="Description of Artificial Sequence: Synthetic oligonucleotide"
acagguacuuuauugcccaagaa

SEQ ID NO: 2243 - RNA, 23 nt, Artificial Sequence
  source: /note="Description of Artificial Sequence: Synthetic oligonucleotide"
acucuagugaaaaacugggaaag

SEQ ID NO: 2244 - RNA, 23 nt, Artificial Sequence
  source: /note="Description of Artificial Sequence: Synthetic oligonucleotide"
aaagaaucugcuagacucgccuc

SEQ ID NO: 2245 - RNA, 23 nt, Artificial Sequence
  source: /note="Description of Artificial Sequence: Synthetic oligonucleotide"
aaaagaaucugcuagacucgccu

SEQ ID NO: 2246 - RNA, 23 nt, Artificial Sequence
  source: /note="Description of Artificial Sequence: Synthetic oligonucleotide"
agaaagaaucugcuagacucgcc

SEQ ID NO: 2247 - RNA, 23 nt, Artificial Sequence
  source: /note="Description of Artificial Sequence: Synthetic oligonucleotide"
augaaagaaucugcuagacucgc

SEQ ID NO: 2248 - RNA, 23 nt, Artificial Sequence
  source: /note="Description of Artificial Sequence: Synthetic oligonucleotide"
acugaaagaaucugcuagacucg

SEQ ID NO: 2249 - RNA, 23 nt, Artificial Sequence
  source: /note="Description of Artificial Sequence: Synthetic oligonucleotide"
aucugaaagaaucugcuagacuc

SEQ ID NO: 2250 - RNA, 23 nt, Artificial Sequence
  source: /note="Description of Artificial Sequence: Synthetic oligonucleotide"
acucugaaagaaucugcuagacu

SEQ ID NO: 2251 - RNA, 23 nt, Artificial Sequence
  source: /note="Description of Artificial Sequence: Synthetic oligonucleotide"
aaaagaugggaaacuuuagcacc

SEQ ID NO: 2252 - RNA, 23 nt, Artificial Sequence
  source: /note="Description of Artificial Sequence: Synthetic oligonucleotide"
acaaagaugggaaacuuuagcac

SEQ ID NO: 2253 - RNA, 23 nt, Artificial Sequence
  source: /note="Description of Artificial Sequence: Synthetic oligonucleotide"
aacaaagaugggaaacuuuagca

SEQ ID NO: 2254 - RNA, 23 nt, Artificial Sequence
  source: /note="Description of Artificial Sequence: Synthetic oligonucleotide"
acacaaagaugggaaacuuuagc

SEQ ID NO: 2255 - RNA, 23 nt, Artificial Sequence
  source: /note="Description of Artificial Sequence: Synthetic oligonucleotide"
augcacaaagaugggaaacuuua

SEQ ID NO: 2256 - RNA, 23 nt, Artificial Sequence
  source: /note="Description of Artificial Sequence: Synthetic oligonucleotide"
auaaaaccaacucagcucagagg

SEQ ID NO: 2257 - RNA, 23 nt, Artificial Sequence
  source: /note="Description of Artificial Sequence: Synthetic oligonucleotide"
aauaaaaccaacucagcucagag

SEQ ID NO: 2258 - RNA, 23 nt, Artificial Sequence
  source: /note="Description of Artificial Sequence: Synthetic oligonucleotide"
acauaaaaccaacucagcucaga

SEQ ID NO: 2259 - RNA, 23 nt, Artificial Sequence
  source: /note="Description of Artificial Sequence: Synthetic oligonucleotide"
aucauaaaaccaacucagcucag

SEQ ID NO: 2260 - RNA, 23 nt, Artificial Sequence
  source: /note="Description of Artificial Sequence: Synthetic oligonucleotide"
auucauaaaaccaacucagcuca

SEQ ID NO: 2261 - RNA, 23 nt, Artificial Sequence
  source: /note="Description of Artificial Sequence: Synthetic oligonucleotide"
agcuuuucauaaaaccaacucag

SEQ ID NO: 2262 - RNA, 23 nt, Artificial Sequence
  source: /note="Description of Artificial Sequence: Synthetic oligonucleotide"
aagcuuuucauaaaaccaacuca

SEQ ID NO: 2263 - RNA, 23 nt, Artificial Sequence
  source: /note="Description of Artificial Sequence: Synthetic oligonucleotide"
auagcuuuucauaaaaccaacuc

SEQ ID NO: 2264 - RNA, 23 nt, Artificial Sequence
  source: /note="Description of Artificial Sequence: Synthetic oligonucleotide"
acuuccuagcuuuucauaaaacc

SEQ ID NO: 2265 - RNA, 23 nt, Artificial Sequence
  source: /note="Description of Artificial Sequence: Synthetic oligonucleotide"
aaagguugcuuccuagcuuuuca

SEQ ID NO: 2266 - RNA, 23 nt, Artificial Sequence
  source: /note="Description of Artificial Sequence: Synthetic oligonucleotide"
acgaaagguugcuuccuagcuuu

SEQ ID NO: 2267 - RNA, 23 nt, Artificial Sequence
  source: /note="Description of Artificial Sequence: Synthetic oligonucleotide"
agcgaaagguugcuuccuagcuu

SEQ ID NO: 2268 - RNA, 23 nt, Artificial Sequence
  source: /note="Description of Artificial Sequence: Synthetic oligonucleotide"
aaggcgaaagguugcuuccuagc

SEQ ID NO: 2269 - RNA, 23 nt, Artificial Sequence
  source: /note="Description of Artificial Sequence: Synthetic oligonucleotide"
aguauuagaguuaagugcuggac

SEQ ID NO: 2270 - RNA, 23 nt, Artificial Sequence
  source: /note="Description of Artificial Sequence: Synthetic oligonucleotide"
auguauuagaguuaagugcugga

SEQ ID NO: 2271 - RNA, 23 nt, Artificial Sequence
  source: /note="Description of Artificial Sequence: Synthetic oligonucleotide"
aauguauuagaguuaagugcugg

SEQ ID NO: 2272 - RNA, 23 nt, Artificial Sequence
  source: /note="Description of Artificial Sequence: Synthetic oligonucleotide"
acugauguauuagaguuaagugc

SEQ ID NO: 2273 - RNA, 23 nt, Artificial Sequence
  source: /note="Description of Artificial Sequence: Synthetic oligonucleotide"
acgcaugcugauguauuagaguu

SEQ ID NO: 2274 - RNA, 23 nt, Artificial Sequence
  source: /note="Description of Artificial Sequence: Synthetic oligonucleotide"
aacgcaugcugauguauuagagu

SEQ ID NO: 2275 - RNA, 23 nt, Artificial Sequence
  source: /note="Description of Artificial Sequence: Synthetic oligonucleotide"
aaacgcaugcugauguauuagag

SEQ ID NO: 2276 - RNA, 23 nt, Artificial Sequence
  source: /note="Description of Artificial Sequence: Synthetic oligonucleotide"
auaacgcaugcugauguauuaga

SEQ ID NO: 2277 - RNA, 23 nt, Artificial Sequence
  source: /note="Description of Artificial Sequence: Synthetic oligonucleotide"
aaauuaacgcaugcugauguauu

SEQ ID NO: 2278 - RNA, 23 nt, Artificial Sequence
  source: /note="Description of Artificial Sequence: Synthetic oligonucleotide"
agaauuaacgcaugcugauguau

SEQ ID NO: 2279 - RNA, 23 nt, Artificial Sequence
  source: /note="Description of Artificial Sequence: Synthetic oligonucleotide"
augaauuaacgcaugcugaugua

SEQ ID NO: 2280 - RNA, 23 nt, Artificial Sequence
  source: /note="Description of Artificial Sequence: Synthetic oligonucleotide"
agcugaauuaacgcaugcugaug

SEQ ID NO: 2281 - RNA, 23 nt, Artificial Sequence
  source: /note="Description of Artificial Sequence: Synthetic oligonucleotide"
acagcugaauuaacgcaugcuga

SEQ ID NO: 2282 - RNA, 23 nt, Artificial Sequence
  source: /note="Description of Artificial Sequence: Synthetic oligonucleotide"
acgaaacagucaguaagggaccc

SEQ ID NO: 2283 - RNA, 23 nt, Artificial Sequence
  source: /note="Description of Artificial Sequence: Synthetic oligonucleotide"
aacgaaacagucaguaagggacc

SEQ ID NO: 2284 - RNA, 23 nt, Artificial Sequence
  source: /note="Description of Artificial Sequence: Synthetic oligonucleotide"
acacgaaacagucaguaagggac

SEQ ID NO: 2285 - RNA, 23 nt, Artificial Sequence
  source: /note="Description of Artificial Sequence: Synthetic oligonucleotide"
accacgaaacagucaguaaggga

SEQ ID NO: 2286 - RNA, 23 nt, Artificial Sequence
  source: /note="Description of Artificial Sequence: Synthetic oligonucleotide"
acuaagaaccucaugcuggaaca

SEQ ID NO: 2287 - RNA, 23 nt, Artificial Sequence
  source: /note="Description of Artificial Sequence: Synthetic oligonucleotide"
auucuaagaaccucaugcuggaa

SEQ ID NO: 2288 - RNA, 23 nt, Artificial Sequence
  source: /note="Description of Artificial Sequence: Synthetic oligonucleotide"
aauucuaagaaccucaugcugga

SEQ ID NO: 2289 - RNA, 23 nt, Artificial Sequence
  source: /note="Description of Artificial Sequence: Synthetic oligonucleotide"
acauucuaagaaccucaugcugg

SEQ ID NO: 2290 - RNA, 23 nt, Artificial Sequence
  source: /note="Description of Artificial Sequence: Synthetic oligonucleotide"
agucauucuaagaaccucaugcu

SEQ ID NO: 2291 - RNA, 23 nt, Artificial Sequence
  source: /note="Description of Artificial Sequence: Synthetic oligonucleotide"
aaacaccugucauucuaagaacc

SEQ ID NO: 2292 - RNA, 23 nt, Artificial Sequence
  source: /note="Description of Artificial Sequence: Synthetic oligonucleotide"
agguuaucaucuuugcagaccac

SEQ ID NO: 2293 - RNA, 23 nt, Artificial Sequence
  source: /note="Description of Artificial Sequence: Synthetic oligonucleotide"
aagguuaucaucuuugcagacca

SEQ ID NO: 2294 - RNA, 23 nt, Artificial Sequence
  source: /note="Description of Artificial Sequence: Synthetic oligonucleotide"
aaagguuaucaucuuugcagacc

SEQ ID NO: 2295 - RNA, 23 nt, Artificial Sequence
  source: /note="Description of Artificial Sequence: Synthetic oligonucleotide"
acaagguuaucaucuuugcagac

SEQ ID NO: 2296 - RNA, 23 nt, Artificial Sequence
  source: /note="Description of Artificial Sequence: Synthetic oligonucleotide"
aagucaagguuaucaucuuugca

SEQ ID NO: 2297 - RNA, 23 nt, Artificial Sequence
  source: /note="Description of Artificial Sequence: Synthetic oligonucleotide"
aguuuuuaguagucaagguuauc

SEQ ID NO: 2298 - RNA, 23 nt, Artificial Sequence
  source: /note="Description of Artificial Sequence: Synthetic oligonucleotide"
acguuuuuaguagucaagguuau

SEQ ID NO: 2299 - RNA, 23 nt, Artificial Sequence
  source: /note="Description of Artificial Sequence: Synthetic oligonucleotide"
aacguuuuuaguagucaagguua

SEQ ID NO: 2300 - RNA, 23 nt, Artificial Sequence
  source: /note="Description of Artificial Sequence: Synthetic oligonucleotide"
agacguuuuuaguagucaagguu

SEQ ID NO: 2301 - RNA, 23 nt, Artificial Sequence
  source: /note="Description of Artificial Sequence: Synthetic oligonucleotide"
aagacguuuuuaguagucaaggu

SEQ ID NO: 2302 - RNA, 23 nt, Artificial Sequence
  source: /note="Description of Artificial Sequence: Synthetic oligonucleotide"
agagacguuuuuaguagucaagg

SEQ ID NO: 2303 - RNA, 23 nt, Artificial Sequence
  source: /note="Description of Artificial Sequence: Synthetic oligonucleotide"
aagauuaucaucuuguuaccccc

SEQ ID NO: 2304 - RNA, 23 nt, Artificial Sequence
  source: /note="Description of Artificial Sequence: Synthetic oligonucleotide"
auagauuaucaucuuguuacccc

SEQ ID NO: 2305 - RNA, 23 nt, Artificial Sequence
  source: /note="Description of Artificial Sequence: Synthetic oligonucleotide"
aguagauuaucaucuuguuaccc

SEQ ID NO: 2306 - RNA, 23 nt, Artificial Sequence
  source: /note="Description of Artificial Sequence: Synthetic oligonucleotide"
aaguagauuaucaucuuguuacc

SEQ ID NO: 2307 - RNA, 23 nt, Artificial Sequence
  source: /note="Description of Artificial Sequence: Synthetic oligonucleotide"
aaaguagauuaucaucuuguuac

SEQ ID NO: 2308 - RNA, 23 nt, Artificial Sequence
  source: /note="Description of Artificial Sequence: Synthetic oligonucleotide"
agugaaaaagguguucuaaaauu

SEQ ID NO: 2309 - RNA, 23 nt, Artificial Sequence
  source: /note="Description of Artificial Sequence: Synthetic oligonucleotide"
auaguuaggugaaaaagguguuc

SEQ ID NO: 2310 - RNA, 23 nt, Artificial Sequence
  source: /note="Description of Artificial Sequence: Synthetic oligonucleotide"
auuaguuaggugaaaaagguguu

SEQ ID NO: 2311 - RNA, 23 nt, Artificial Sequence
  source: /note="Description of Artificial Sequence: Synthetic oligonucleotide"
aauuuuaguuaggugaaaaaggu

SEQ ID NO: 2312 - RNA, 23 nt, Artificial Sequence
  source: /note="Description of Artificial Sequence: Synthetic oligonucleotide"
auauuuuaguuaggugaaaaagg

SEQ ID NO: 2313 - RNA, 23 nt, Artificial Sequence
  source: /note="Description of Artificial Sequence: Synthetic oligonucleotide"
auuauuuuaguuaggugaaaaag

SEQ ID NO: 2314 - RNA, 23 nt, Artificial Sequence
  source: /note="Description of Artificial Sequence: Synthetic oligonucleotide"
aauuauuuuaguuaggugaaaaa

SEQ ID NO: 2315 - RNA, 23 nt, Artificial Sequence
  source: /note="Description of Artificial Sequence: Synthetic oligonucleotide"
acauuauuuuaguuaggugaaaa

SEQ ID NO: 2316 - RNA, 23 nt, Artificial Sequence
  source: /note="Description of Artificial Sequence: Synthetic oligonucleotide"
aacauuauuuuaguuaggugaaa

SEQ ID NO: 2317 - RNA, 23 nt, Artificial Sequence
  source: /note="Description of Artificial Sequence: Synthetic oligonucleotide"
aaacauuauuuuaguuaggugaa

SEQ ID NO: 2318 - RNA, 23 nt, Artificial Sequence
  source: /note="Description of Artificial Sequence: Synthetic oligonucleotide"
aguaacaacgcuuccuuacauuu

SEQ ID NO: 2319 - RNA, 23 nt, Artificial Sequence
  source: /note="Description of Artificial Sequence: Synthetic oligonucleotide"
auucaacagguaacaacgcuucc

SEQ ID NO: 2320 - RNA, 23 nt, Artificial Sequence
  source: /note="Description of Artificial Sequence: Synthetic oligonucleotide"
aauucaacagguaacaacgcuuc

SEQ ID NO: 2321 - RNA, 23 nt, Artificial Sequence
  source: /note="Description of Artificial Sequence: Synthetic oligonucleotide"
aaaaauucaacagguaacaacgc

SEQ ID NO: 2322 - RNA, 23 nt, Artificial Sequence
  source: /note="Description of Artificial Sequence: Synthetic oligonucleotide"
acaaaauucaacagguaacaacg

SEQ ID NO: 2323 - RNA, 23 nt, Artificial Sequence
  source: /note="Description of Artificial Sequence: Synthetic oligonucleotide"
aacaaaauucaacagguaacaac

SEQ ID NO: 2324 - RNA, 23 nt, Artificial Sequence
  source: /note="Description of Artificial Sequence: Synthetic oligonucleotide"
aauacaaaauucaacagguaaca

SEQ ID NO: 2325 - RNA, 23 nt, Artificial Sequence
  source: /note="Description of Artificial Sequence: Synthetic oligonucleotide"
aaauacaaaauucaacagguaac

SEQ ID NO: 2326 - RNA, 23 nt, Artificial Sequence
  source: /note="Description of Artificial Sequence: Synthetic oligonucleotide"
auaauacaaaauucaacagguaa

SEQ ID NO: 2327 - RNA, 23 nt, Artificial Sequence
  source: /note="Description of Artificial Sequence: Synthetic oligonucleotide"
acauaauacaaaauucaacaggu

SEQ ID NO: 2328 - RNA, 23 nt, Artificial Sequence
  source: /note="Description of Artificial Sequence: Synthetic oligonucleotide"
acacauaauacaaaauucaacag

SEQ ID NO: 2329 - RNA, 23 nt, Artificial Sequence
  source: /note="Description of Artificial Sequence: Synthetic oligonucleotide"
aauucuacuaacaucucacugau

SEQ ID NO: 2330 - RNA, 23 nt, Artificial Sequence
  source: /note="Description of Artificial Sequence: Synthetic oligonucleotide"
agcuuauucuacuaacaucucac

SEQ ID NO: 2331 - RNA, 23 nt, Artificial Sequence
  source: /note="Description of Artificial Sequence: Synthetic oligonucleotide"
auuuuaaggcuuauucuacuaac

SEQ ID NO: 2332 - RNA, 23 nt, Artificial Sequence
  source: /note="Description of Artificial Sequence: Synthetic oligonucleotide"
augaaauggugcaaucucagcuc

SEQ ID NO: 2333 - RNA, 23 nt, Artificial Sequence
  source: /note="Description of Artificial Sequence: Synthetic oligonucleotide"
aaugaaauggugcaaucucagcu

SEQ ID NO: 2334 - RNA, 23 nt, Artificial Sequence
  source: /note="Description of Artificial Sequence: Synthetic oligonucleotide"
aaaugaaauggugcaaucucagc

SEQ ID NO: 2335 - RNA, 23 nt, Artificial Sequence
  source: /note="Description of Artificial Sequence: Synthetic oligonucleotide"
aggaaugaaauggugcaaucuca

SEQ ID NO: 2336 - RNA, 23 nt, Artificial Sequence
  source: /note="Description of Artificial Sequence: Synthetic oligonucleotide"
agcacacuagauuauuuuguuuu

SEQ ID NO: 2337 - RNA, 23 nt, Artificial Sequence
  source: /note="Description of Artificial Sequence: Synthetic oligonucleotide"
acugcacacuagauuauuuuguu

SEQ ID NO: 2338 - RNA, 23 nt, Artificial Sequence
  source: /note="Description of Artificial Sequence: Synthetic oligonucleotide"
aagaaaauaagccagguucaagu

SEQ ID NO: 2339 - RNA, 23 nt, Artificial Sequence
  source: /note="Description of Artificial Sequence: Synthetic oligonucleotide"
aagaaacucacugaccauguggg

SEQ ID NO: 2340 - RNA, 23 nt, Artificial Sequence
  source: /note="Description of Artificial Sequence: Synthetic oligonucleotide"
agguccucucagaucuugugcgg

SEQ ID NO: 2341 - RNA, 23 nt, Artificial Sequence
  source: /note="Description of Artificial Sequence: Synthetic oligonucleotide"
uccauccauccuucaacuuaagc

SEQ ID NO: 2342 - RNA, 23 nt, Artificial Sequence
  source: /note="Description of Artificial Sequence: Synthetic oligonucleotide"
ccauccauccuucaacuuaagca

SEQ ID NO: 2343 - RNA, 23 nt, Artificial Sequence
  source: /note="Description of Artificial Sequence: Synthetic oligonucleotide"
cauccauccuucaacuuaagcaa

SEQ ID NO: 2344 - RNA, 23 nt, Artificial Sequence
  source: /note="Description of Artificial Sequence: Synthetic oligonucleotide"
acuuaagcaaguuccuccgacag

SEQ ID NO: 2345 - RNA, 23 nt, Artificial Sequence
  source: /note="Description of Artificial Sequence: Synthetic oligonucleotide"
cggcaaaauaggcaucucucuua

SEQ ID NO: 2346 - RNA, 23 nt, Artificial Sequence
  source: /note="Description of Artificial Sequence: Synthetic oligonucleotide"
gcaaaauaggcaucucucuuacc

SEQ ID NO: 2347 - RNA, 23 nt, Artificial Sequence
  source: /note="Description of Artificial Sequence: Synthetic oligonucleotide"
caaaauaggcaucucucuuacca

SEQ ID NO: 2348 - RNA, 23 nt, Artificial Sequence
  source: /note="Description of Artificial Sequence: Synthetic oligonucleotide"
aaauaggcaucucucuuaccaga

SEQ ID NO: 2349 - RNA, 23 nt, Artificial Sequence
  source: /note="Description of Artificial Sequence: Synthetic oligonucleotide"
gcaucucucuuaccagagugucu

SEQ ID NO: 2350 - RNA, 23 nt, Artificial Sequence
  source: /note="Description of Artificial Sequence: Synthetic oligonucleotide"
ugacuuucgguccaaagacgaag

SEQ ID NO: 2351 - RNA, 23 nt, Artificial Sequence
  source: /note="Description of Artificial Sequence: Synthetic oligonucleotide"
acuuucgguccaaagacgaaguc

SEQ ID NO: 2352 - RNA, 23 nt, Artificial Sequence
  source: /note="Description of Artificial Sequence: Synthetic oligonucleotide"
uucgguccaaagacgaagucgug

SEQ ID NO: 2353 - RNA, 23 nt, Artificial Sequence
  source: /note="Description of Artificial Sequence: Synthetic oligonucleotide"
ucgguccaaagacgaagucgugg

SEQ ID NO: 2354 - RNA, 23 nt, Artificial Sequence
  source: /note="Description of Artificial Sequence: Synthetic oligonucleotide"
ccuugguauguuccugcuucauc

SEQ ID NO: 2355 - RNA, 23 nt, Artificial Sequence
  source: /note="Description of Artificial Sequence: Synthetic oligonucleotide"
agugacaacguacccuucauuga

SEQ ID NO: 2356 - RNA, 23 nt, Artificial Sequence
  source: /note="Description of Artificial Sequence: Synthetic oligonucleotide"
gugacaacguacccuucauugau

SEQ ID NO: 2357 - RNA, 23 nt, Artificial Sequence
  source: /note="Description of Artificial Sequence: Synthetic oligonucleotide"
ugacaacguacccuucauugaug

SEQ ID NO: 2358 - RNA, 23 nt, Artificial Sequence
  source: /note="Description of Artificial Sequence: Synthetic oligonucleotide"
gacaacguacccuucauugaugc

SEQ ID NO: 2359 - RNA, 23 nt, Artificial Sequence
  source: /note="Description of Artificial Sequence: Synthetic oligonucleotide"
acaacguacccuucauugaugcc

SEQ ID NO: 2360 - RNA, 23 nt, Artificial Sequence
  source: /note="Description of Artificial Sequence: Synthetic oligonucleotide"
ccuaaagucaaguccacgaacuu

SEQ ID NO: 2361 - RNA, 23 nt, Artificial Sequence
  source: /note="Description of Artificial Sequence: Synthetic oligonucleotide"
cuaaagucaaguccacgaacuuu

SEQ ID NO: 2362 - RNA, 23 nt, Artificial Sequence
  source: /note="Description of Artificial Sequence: Synthetic oligonucleotide"
aguccacgaacuuucuucaugug

SEQ ID NO: 2363 - RNA, 23 nt, Artificial Sequence
  source: /note="Description of Artificial Sequence: Synthetic oligonucleotide"
guccacgaacuuucuucaugugg

SEQ ID NO: 2364 - RNA, 23 nt, Artificial Sequence
  source: /note="Description of Artificial Sequence: Synthetic oligonucleotide"
uccacgaacuuucuucaugugga

SEQ ID NO: 2365 - RNA, 23 nt, Artificial Sequence
  source: /note="Description of Artificial Sequence: Synthetic oligonucleotide"
ccacgaacuuucuucauguggac

SEQ ID NO: 2366 - RNA, 23 nt, Artificial Sequence
  source: /note="Description of Artificial Sequence: Synthetic oligonucleotide"
cacgaacuuucuucauguggaca

SEQ ID NO: 2367 - RNA, 23 nt, Artificial Sequence
  source: /note="Description of Artificial Sequence: Synthetic oligonucleotide"
ccuucucucgagagcuuuugucc

SEQ ID NO: 2368 - RNA, 23 nt, Artificial Sequence
  source: /note="Description of Artificial Sequence: Synthetic oligonucleotide"
cuugcuacccauuaggauaaugu

SEQ ID NO: 2369 - RNA, 23 nt, Artificial Sequence
  source: /note="Description of Artificial Sequence: Synthetic oligonucleotide"
uugcuacccauuaggauaauguc

SEQ ID NO: 2370 - RNA, 23 nt, Artificial Sequence
  source: /note="Description of Artificial Sequence: Synthetic oligonucleotide"
ugcuacccauuaggauaaugucu

SEQ ID NO: 2371 - RNA, 23 nt, Artificial Sequence
  source: /note="Description of Artificial Sequence: Synthetic oligonucleotide"
gcuacccauuaggauaaugucuu

SEQ ID NO: 2372 - RNA, 23 nt, Artificial Sequence
  source: /note="Description of Artificial Sequence: Synthetic oligonucleotide"
cuacccauuaggauaaugucuua

SEQ ID NO: 2373 - RNA, 23 nt, Artificial Sequence
  source: /note="Description of Artificial Sequence: Synthetic oligonucleotide"
cauuaggauaaugucuuauguaa

SEQ ID NO: 2374 - RNA, 23 nt, Artificial Sequence
  source: /note="Description of Artificial Sequence: Synthetic oligonucleotide"
auuaggauaaugucuuauguaau

SEQ ID NO: 2375 - RNA, 23 nt, Artificial Sequence
  source: /note="Description of Artificial Sequence: Synthetic oligonucleotide"
ccucacagguguucacucgagug

SEQ ID NO: 2376 - RNA, 23 nt, Artificial Sequence
  source: /note="Description of Artificial Sequence: Synthetic oligonucleotide"
uucuugggcaauaaaguaccugc

SEQ ID NO: 2377 - RNA, 23 nt, Artificial Sequence
  source: /note="Description of Artificial Sequence: Synthetic oligonucleotide"
cuuucccaguuuuucacuagaga

SEQ ID NO: 2378 - RNA, 23 nt, Artificial Sequence
  source: /note="Description of Artificial Sequence: Synthetic oligonucleotide"
gaggcgagucuagcagauucuuu

SEQ ID NO: 2379 - RNA, 23 nt, Artificial Sequence
  source: /note="Description of Artificial Sequence: Synthetic oligonucleotide"
aggcgagucuagcagauucuuuc

SEQ ID NO: 2380 - RNA, 23 nt, Artificial Sequence
  source: /note="Description of Artificial Sequence: Synthetic oligonucleotide"
ggcgagucuagcagauucuuuca

SEQ ID NO: 2381 - RNA, 23 nt, Artificial Sequence
  source: /note="Description of Artificial Sequence: Synthetic oligonucleotide"
gcgagucuagcagauucuuucag

SEQ ID NO: 2382 - RNA, 23 nt, Artificial Sequence
  source: /note="Description of Artificial Sequence: Synthetic oligonucleotide"
cgagucuagcagauucuuucaga

SEQ ID NO: 2383 - RNA, 23 nt, Artificial Sequence
  source: /note="Description of Artificial Sequence: Synthetic oligonucleotide"
gagucuagcagauucuuucagag

SEQ ID NO: 2384 - RNA, 23 nt, Artificial Sequence
  source: /note="Description of Artificial Sequence: Synthetic oligonucleotide"
agucuagcagauucuuucagagg

SEQ ID NO: 2385 - RNA, 23 nt, Artificial Sequence
  source: /note="Description of Artificial Sequence: Synthetic oligonucleotide"
ggugcuaaaguuucccaucuuug

SEQ ID NO: 2386 - RNA, 23 nt, Artificial Sequence
  source: /note="Description of Artificial Sequence: Synthetic oligonucleotide"
gugcuaaaguuucccaucuuugu

SEQ ID NO: 2387 - RNA, 23 nt, Artificial Sequence
  source: /note="Description of Artificial Sequence: Synthetic oligonucleotide"
ugcuaaaguuucccaucuuugug

SEQ ID NO: 2388 - RNA, 23 nt, Artificial Sequence
  source: /note="Description of Artificial Sequence: Synthetic oligonucleotide"
gcuaaaguuucccaucuuugugc

SEQ ID NO: 2389 - RNA, 23 nt, Artificial Sequence
  source: /note="Description of Artificial Sequence: Synthetic oligonucleotide"
uaaaguuucccaucuuugugcag

SEQ ID NO: 2390 - RNA, 23 nt, Artificial Sequence
  source: /note="Description of Artificial Sequence: Synthetic oligonucleotide"
ccucugagcugaguugguuuuau

SEQ ID NO: 2391 - RNA, 23 nt, Artificial Sequence
  source: /note="Description of Artificial Sequence: Synthetic oligonucleotide"
cucugagcugaguugguuuuaug

SEQ ID NO: 2392 - RNA, 23 nt, Artificial Sequence
  source: /note="Description of Artificial Sequence: Synthetic oligonucleotide"
ucugagcugaguugguuuuauga

SEQ ID NO: 2393 - RNA, 23 nt, Artificial Sequence
  source: /note="Description of Artificial Sequence: Synthetic oligonucleotide"
cugagcugaguugguuuuaugaa

SEQ ID NO: 2394 - RNA, 23 nt, Artificial Sequence
  source: /note="Description of Artificial Sequence: Synthetic oligonucleotide"
ugagcugaguugguuuuaugaaa

SEQ ID NO: 2395 - RNA, 23 nt, Artificial Sequence
  source: /note="Description of Artificial Sequence: Synthetic oligonucleotide"
cugaguugguuuuaugaaaagcu

SEQ ID NO: 2396 - RNA, 23 nt, Artificial Sequence
  source: /note="Description of Artificial Sequence: Synthetic oligonucleotide"
ugaguugguuuuaugaaaagcua

SEQ ID NO: 2397 - RNA, 23 nt, Artificial Sequence
  source: /note="Description of Artificial Sequence: Synthetic oligonucleotide"
gaguugguuuuaugaaaagcuag

SEQ ID NO: 2398 - RNA, 23 nt, Artificial Sequence
  source: /note="Description of Artificial Sequence: Synthetic oligonucleotide"
gguuuuaugaaaagcuaggaagc

SEQ ID NO: 2399 - RNA, 23 nt, Artificial Sequence
  source: /note="Description of Artificial Sequence: Synthetic oligonucleotide"
ugaaaagcuaggaagcaaccuuu

SEQ ID NO: 2400 - RNA, 23 nt, Artificial Sequence
  source: /note="Description of Artificial Sequence: Synthetic oligonucleotide"
aaagcuaggaagcaaccuuucgc

SEQ ID NO: 2401 - RNA, 23 nt, Artificial Sequence
  source: /note="Description of Artificial Sequence: Synthetic oligonucleotide"
aagcuaggaagcaaccuuucgcc

SEQ ID NO: 2402 - RNA, 23 nt, Artificial Sequence
  source: /note="Description of Artificial Sequence: Synthetic oligonucleotide"
gcuaggaagcaaccuuucgccug

SEQ ID NO: 2403 - RNA, 23 nt, Artificial Sequence
  source: /note="Description of Artificial Sequence: Synthetic oligonucleotide"
guccagcacuuaacucuaauaca

SEQ ID NO: 2404 - RNA, 23 nt, Artificial Sequence
  source: /note="Description of Artificial Sequence: Synthetic oligonucleotide"
uccagcacuuaacucuaauacau

SEQ ID NO: 2405 - RNA, 23 nt, Artificial Sequence
  source: /note="Description of Artificial Sequence: Synthetic oligonucleotide"
ccagcacuuaacucuaauacauc

SEQ ID NO: 2406 - RNA, 23 nt, Artificial Sequence
  source: /note="Description of Artificial Sequence: Synthetic oligonucleotide"
gcacuuaacucuaauacaucagc

SEQ ID NO: 2407 - RNA, 23 nt, Artificial Sequence
  source: /note="Description of Artificial Sequence: Synthetic oligonucleotide"
aacucuaauacaucagcaugcgu

SEQ ID NO: 2408 - RNA, 23 nt, Artificial Sequence
  source: /note="Description of Artificial Sequence: Synthetic oligonucleotide"
acucuaauacaucagcaugcguu

SEQ ID NO: 2409 - RNA, 23 nt, Artificial Sequence
  source: /note="Description of Artificial Sequence: Synthetic oligonucleotide"
cucuaauacaucagcaugcguua

SEQ ID NO: 2410 - RNA, 23 nt, Artificial Sequence
  source: /note="Description of Artificial Sequence: Synthetic oligonucleotide"
ucuaauacaucagcaugcguuaa

SEQ ID NO: 2411 - RNA, 23 nt, Artificial Sequence
  source: /note="Description of Artificial Sequence: Synthetic oligonucleotide"
aauacaucagcaugcguuaauuc

SEQ ID NO: 2412 - RNA, 23 nt, Artificial Sequence
  source: /note="Description of Artificial Sequence: Synthetic oligonucleotide"
auacaucagcaugcguuaauuca

SEQ ID NO: 2413 - RNA, 23 nt, Artificial Sequence
  source: /note="Description of Artificial Sequence: Synthetic oligonucleotide"
uacaucagcaugcguuaauucag

SEQ ID NO: 2414 - RNA, 23 nt, Artificial Sequence
  source: /note="Description of Artificial Sequence: Synthetic oligonucleotide"
caucagcaugcguuaauucagcu

SEQ ID NO: 2415 - RNA, 23 nt, Artificial Sequence
  source: /note="Description of Artificial Sequence: Synthetic oligonucleotide"
ucagcaugcguuaauucagcugg

SEQ ID NO: 2416 - RNA, 23 nt, Artificial Sequence
  source: /note="Description of Artificial Sequence: Synthetic oligonucleotide"
gggucccuuacugacuguuucgu

SEQ ID NO: 2417 - RNA, 23 nt, Artificial Sequence
  source: /note="Description of Artificial Sequence: Synthetic oligonucleotide"
ggucccuuacugacuguuucgug

SEQ ID NO: 2418 - RNA, 23 nt, Artificial Sequence
  source: /note="Description of Artificial Sequence: Synthetic oligonucleotide"
gucccuuacugacuguuucgugg

SEQ ID NO: 2419 - RNA, 23 nt, Artificial Sequence
  source: /note="Description of Artificial Sequence: Synthetic oligonucleotide"
ucccuuacugacuguuucguggc

SEQ ID NO: 2420 - RNA, 23 nt, Artificial Sequence
  source: /note="Description of Artificial Sequence: Synthetic oligonucleotide"
uguuccagcaugagguucuuaga

SEQ ID NO: 2421 - RNA, 23 nt, Artificial Sequence
  source: /note="Description of Artificial Sequence: Synthetic oligonucleotide"
uuccagcaugagguucuuagaau

SEQ ID NO: 2422 - RNA, 23 nt, Artificial Sequence
  source: /note="Description of Artificial Sequence: Synthetic oligonucleotide"
uccagcaugagguucuuagaaug

SEQ ID NO: 2423 - RNA, 23 nt, Artificial Sequence
  source: /note="Description of Artificial Sequence: Synthetic oligonucleotide"
ccagcaugagguucuuagaauga

SEQ ID NO: 2424 - RNA, 23 nt, Artificial Sequence
  source: /note="Description of Artificial Sequence: Synthetic oligonucleotide"
agcaugagguucuuagaaugaca

SEQ ID NO: 2425 - RNA, 23 nt, Artificial Sequence
  source: /note="Description of Artificial Sequence: Synthetic oligonucleotide"
gguucuuagaaugacagguguuu

SEQ ID NO: 2426 - RNA, 23 nt, Artificial Sequence
  source: /note="Description of Artificial Sequence: Synthetic oligonucleotide"
guggucugcaaagaugauaaccu

SEQ ID NO: 2427 - RNA, 23 nt, Artificial Sequence
  source: /note="Description of Artificial Sequence: Synthetic oligonucleotide"
uggucugcaaagaugauaaccuu

SEQ ID NO: 2428 - RNA, 23 nt, Artificial Sequence
  source: /note="Description of Artificial Sequence: Synthetic oligonucleotide"
ggucugcaaagaugauaaccuug

SEQ ID NO: 2429 - RNA, 23 nt, Artificial Sequence
  source: /note="Description of Artificial Sequence: Synthetic oligonucleotide"
gucugcaaagaugauaaccuuga

SEQ ID NO: 2430 - RNA, 23 nt, Artificial Sequence
  source: /note="Description of Artificial Sequence: Synthetic oligonucleotide"
ugcaaagaugauaaccuugacua

SEQ ID NO: 2431 - RNA, 23 nt, Artificial Sequence
  source: /note="Description of Artificial Sequence: Synthetic oligonucleotide"
gauaaccuugacuacuaaaaacg

SEQ ID NO: 2432 - RNA, 23 nt, Artificial Sequence
  source: /note="Description of Artificial Sequence: Synthetic oligonucleotide"
auaaccuugacuacuaaaaacgu

SEQ ID NO: 2433 - RNA, 23 nt, Artificial Sequence
  source: /note="Description of Artificial Sequence: Synthetic oligonucleotide"
uaaccuugacuacuaaaaacguc

SEQ ID NO: 2434 - RNA, 23 nt, Artificial Sequence
  source: /note="Description of Artificial Sequence: Synthetic oligonucleotide"
aaccuugacuacuaaaaacgucu

SEQ ID NO: 2435 - RNA, 23 nt, Artificial Sequence
  source: /note="Description of Artificial Sequence: Synthetic oligonucleotide"
accuugacuacuaaaaacgucuc

SEQ ID NO: 2436 - RNA, 23 nt, Artificial Sequence
  source: /note="Description of Artificial Sequence: Synthetic oligonucleotide"
ccuugacuacuaaaaacgucucc

SEQ ID NO: 2437 - RNA, 23 nt, Artificial Sequence
  source: /note="Description of Artificial Sequence: Synthetic oligonucleotide"
ggggguaacaagaugauaaucua

SEQ ID NO: 2438 - RNA, 23 nt, Artificial Sequence
  source: /note="Description of Artificial Sequence: Synthetic oligonucleotide"
gggguaacaagaugauaaucuac

SEQ ID NO: 2439 - RNA, 23 nt, Artificial Sequence
  source: /note="Description of Artificial Sequence: Synthetic oligonucleotide"
ggguaacaagaugauaaucuacu

SEQ ID NO: 2440 - RNA, 23 nt, Artificial Sequence
  source: /note="Description of Artificial Sequence: Synthetic oligonucleotide"
gguaacaagaugauaaucuacuu

SEQ ID NO: 2441 - RNA, 23 nt, Artificial Sequence
  source: /note="Description of Artificial Sequence: Synthetic oligonucleotide"
guaacaagaugauaaucuacuua

SEQ ID NO: 2442 - RNA, 23 nt, Artificial Sequence
  source: /note="Description of Artificial Sequence: Synthetic oligonucleotide"
aauuuuagaacaccuuuuucacc

SEQ ID NO: 2443 - RNA, 23 nt, Artificial Sequence
  source: /note="Description of Artificial Sequence: Synthetic oligonucleotide"
gaacaccuuuuucaccuaacuaa

SEQ ID NO: 2444 - RNA, 23 nt, Artificial Sequence
  source: /note="Description of Artificial Sequence: Synthetic oligonucleotide"
aacaccuuuuucaccuaacuaaa

SEQ ID NO: 2445 - RNA, 23 nt, Artificial Sequence
  source: /note="Description of Artificial Sequence: Synthetic oligonucleotide"
accuuuuucaccuaacuaaaaua

SEQ ID NO: 2446 - RNA, 23 nt, Artificial Sequence
  source: /note="Description of Artificial Sequence: Synthetic oligonucleotide"
ccuuuuucaccuaacuaaaauaa

SEQ ID NO: 2447 - RNA, 23 nt, Artificial Sequence
  source: /note="Description of Artificial Sequence: Synthetic oligonucleotide"
cuuuuucaccuaacuaaaauaau

SEQ ID NO: 2448 - RNA, 23 nt, Artificial Sequence
  source: /note="Description of Artificial Sequence: Synthetic oligonucleotide"
uuuuucaccuaacuaaaauaaug

SEQ ID NO: 2449 - RNA, 23 nt, Artificial Sequence
  source: /note="Description of Artificial Sequence: Synthetic oligonucleotide"
uuuucaccuaacuaaaauaaugu

SEQ ID NO: 2450 - RNA, 23 nt, Artificial Sequence
  source: /note="Description of Artificial Sequence: Synthetic oligonucleotide"
uuucaccuaacuaaaauaauguu

SEQ ID NO: 2451 - RNA, 23 nt, Artificial Sequence
  source: /note="Description of Artificial Sequence: Synthetic oligonucleotide"
uucaccuaacuaaaauaauguuu

SEQ ID NO: 2452 - RNA, 23 nt, Artificial Sequence
  source: /note="Description of Artificial Sequence: Synthetic oligonucleotide"
aaauguaaggaagcguuguuacc

SEQ ID NO: 2453 - RNA, 23 nt, Artificial Sequence
  source: /note="Description of Artificial Sequence: Synthetic oligonucleotide"
ggaagcguuguuaccuguugaau

SEQ ID NO: 2454 - RNA, 23 nt, Artificial Sequence
  source: /note="Description of Artificial Sequence: Synthetic oligonucleotide"
gaagcguuguuaccuguugaauu

SEQ ID NO: 2455 - RNA, 23 nt, Artificial Sequence
  source: /note="Description of Artificial Sequence: Synthetic oligonucleotide"
gcguuguuaccuguugaauuuug

SEQ ID NO: 2456 - RNA, 23 nt, Artificial Sequence
  source: /note="Description of Artificial Sequence: Synthetic oligonucleotide"
cguuguuaccuguugaauuuugu

SEQ ID NO: 2457 - RNA, 23 nt, Artificial Sequence
  source: /note="Description of Artificial Sequence: Synthetic oligonucleotide"
guuguuaccuguugaauuuugua

SEQ ID NO: 2458 - RNA, 23 nt, Artificial Sequence
  source: /note="Description of Artificial Sequence: Synthetic oligonucleotide"
uguuaccuguugaauuuuguauu

SEQ ID NO: 2459 - RNA, 23 nt, Artificial Sequence
  source: /note="Description of Artificial Sequence: Synthetic oligonucleotide"
guuaccuguugaauuuuguauua

SEQ ID NO: 2460 - RNA, 23 nt, Artificial Sequence
  source: /note="Description of Artificial Sequence: Synthetic oligonucleotide"
uuaccuguugaauuuuguauuau

SEQ ID NO: 2461 - RNA, 23 nt, Artificial Sequence
  source: /note="Description of Artificial Sequence: Synthetic oligonucleotide"
accuguugaauuuuguauuaugu

SEQ ID NO: 2462 - RNA, 23 nt, Artificial Sequence
  source: /note="Description of Artificial Sequence: Synthetic oligonucleotide"
cuguugaauuuuguauuauguga

SEQ ID NO: 2463 - RNA, 23 nt, Artificial Sequence
  source: /note="Description of Artificial Sequence: Synthetic oligonucleotide"
aucagugagauguuaguagaaua

SEQ ID NO: 2464 - RNA, 23 nt, Artificial Sequence
  source: /note="Description of Artificial Sequence: Synthetic oligonucleotide"
gugagauguuaguagaauaagcc

SEQ ID NO: 2465 - RNA, 23 nt, Artificial Sequence
  source: /note="Description of Artificial Sequence: Synthetic oligonucleotide"
guuaguagaauaagccuuaaaaa

SEQ ID NO: 2466 - RNA, 23 nt, Artificial Sequence
  source: /note="Description of Artificial Sequence: Synthetic oligonucleotide"
gagcugagauugcaccauuucau

SEQ ID NO: 2467 - RNA, 23 nt, Artificial Sequence
  source: /note="Description of Artificial Sequence: Synthetic oligonucleotide"
agcugagauugcaccauuucauu

SEQ ID NO: 2468 - RNA, 23 nt, Artificial Sequence
  source: /note="Description of Artificial Sequence: Synthetic oligonucleotide"
gcugagauugcaccauuucauuc

SEQ ID NO: 2469 - RNA, 23 nt, Artificial Sequence
  source: /note="Description of Artificial Sequence: Synthetic oligonucleotide"
ugagauugcaccauuucauucca

SEQ ID NO: 2470 - RNA, 23 nt, Artificial Sequence
  source: /note="Description of Artificial Sequence: Synthetic oligonucleotide"
aaaacaaaauaaucuagugugca

SEQ ID NO: 2471 - RNA, 23 nt, Artificial Sequence
  source: /note="Description of Artificial Sequence: Synthetic oligonucleotide"
aacaaaauaaucuagugugcagg

SEQ ID NO: 2472 - RNA, 23 nt, Artificial Sequence
  source: /note="Description of Artificial Sequence: Synthetic oligonucleotide"
acuugaaccuggcuuauuuucug

SEQ ID NO: 2473 - RNA, 23 nt, Artificial Sequence
  source: /note="Description of Artificial Sequence: Synthetic oligonucleotide"
cccacauggucagugaguuucuc

SEQ ID NO: 2474 - RNA, 21 nt, Artificial Sequence
  source: /note="Description of Artificial Sequence: Synthetic oligonucleotide"
gcuacccauuaggauaauguu

SEQ ID NO: 2475 - RNA, 21 nt, Artificial Sequence
  source: /note="Description of Artificial Sequence: Synthetic oligonucleotide"
cuacccauuaggauaaugucu

SEQ ID NO: 2476 - RNA, 21 nt, Artificial Sequence
  source: /note="Description of Artificial Sequence: Synthetic oligonucleotide"
uacccauuaggauaaugucuu

SEQ ID NO: 2477 - RNA, 21 nt, Artificial Sequence
  source: /note="Description of Artificial Sequence: Synthetic oligonucleotide"
acccauuaggauaaugucuua

SEQ ID NO: 2478 - RNA, 21 nt, Artificial Sequence
  source: /note="Description of Artificial Sequence: Synthetic oligonucleotide"
cccauuaggauaaugucuuau

SEQ ID NO: 2479 - RNA, 21 nt, Artificial Sequence
  source: /note="Description of Artificial Sequence: Synthetic oligonucleotide"
ccauuaggauaaugucuuauu

SEQ ID NO: 2480 - RNA, 21 nt, Artificial Sequence
  source: /note="Description of Artificial Sequence: Synthetic oligonucleotide"
cauuaggauaaugucuuaugu

SEQ ID NO: 2481 - RNA, 21 nt, Artificial Sequence
  source: /note="Description of Artificial Sequence: Synthetic oligonucleotide"
auuaggauaaugucuuaugua

SEQ ID NO: 2482 - RNA, 21 nt, Artificial Sequence
  source: /note="Description of Artificial Sequence: Synthetic oligonucleotide"
uuaggauaaugucuuauguaa

SEQ ID NO: 2483 - RNA, 21 nt, Artificial Sequence
  source: /note="Description of Artificial Sequence: Synthetic oligonucleotide"
uaggauaaugucuuauguaau

SEQ ID NO: 2484 - RNA, 21 nt, Artificial Sequence
  source: /note="Description of Artificial Sequence: Synthetic oligonucleotide"
aggauaaugucuuauguaauu

SEQ ID NO: 2485 - RNA, 21 nt, Artificial Sequence
  source: /note="Description of Artificial Sequence: Synthetic oligonucleotide"
ggauaaugucuuauguaaugu

SEQ ID NO: 2486 - RNA, 21 nt, Artificial Sequence
  source: /note="Description of Artificial Sequence: Synthetic oligonucleotide"
gauaaugucuuauguaaugcu

SEQ ID NO: 2487 - RNA, 21 nt, Artificial Sequence
  source: /note="Description of Artificial Sequence: Synthetic oligonucleotide"
auaaugucuuauguaaugcuu

SEQ ID NO: 2488 - RNA, 21 nt, Artificial Sequence
  source: /note="Description of Artificial Sequence: Synthetic oligonucleotide"
uaaugucuuauguaaugcugu

SEQ ID NO: 2489 - RNA, 21 nt, Artificial Sequence
  source: /note="Description of Artificial Sequence: Synthetic oligonucleotide"
aaugucuuauguaaugcugcu

SEQ ID NO: 2490 - RNA, 21 nt, Artificial Sequence
  source: /note="Description of Artificial Sequence: Synthetic oligonucleotide"
augucuuauguaaugcugccu

SEQ ID NO: 2491 - RNA, 21 nt, Artificial Sequence
  source: /note="Description of Artificial Sequence: Synthetic oligonucleotide"
ugucuuauguaaugcugcccu

SEQ ID NO: 2492 - RNA, 21 nt, Artificial Sequence
  source: /note="Description of Artificial Sequence: Synthetic oligonucleotide"
gucuuauguaaugcugcccuu

SEQ ID NO: 2493 - RNA, 21 nt, Artificial Sequence
  source: /note="Description of Artificial Sequence: Synthetic oligonucleotide"
ucuuauguaaugcugcccugu

SEQ ID NO: 2494 - RNA, 21 nt, Artificial Sequence
  source: /note="Description of Artificial Sequence: Synthetic oligonucleotide"
cuuauguaaugcugcccugua

SEQ ID NO: 2495 - RNA, 21 nt, Artificial Sequence
  source: /note="Description of Artificial Sequence: Synthetic oligonucleotide"
cccagccucugagcugaguuu

SEQ ID NO: 2496 - RNA, 21 nt, Artificial Sequence
  source: /note="Description of Artificial Sequence: Synthetic oligonucleotide"
ccagccucugagcugaguugu

SEQ ID NO: 2497 - RNA, 21 nt, Artificial Sequence
  source: /note="Description of Artificial Sequence: Synthetic oligonucleotide"
cagccucugagcugaguuggu

SEQ ID NO: 2498 - RNA, 21 nt, Artificial Sequence
  source: /note="Description of Artificial Sequence: Synthetic oligonucleotide"
agccucugagcugaguugguu

SEQ ID NO: 2499 - RNA, 21 nt, Artificial Sequence
  source: /note="Description of Artificial Sequence: Synthetic oligonucleotide"
gccucugagcugaguugguuu

SEQ ID NO: 2500 - RNA, 21 nt, Artificial Sequence
  source: /note="Description of Artificial Sequence: Synthetic oligonucleotide"
ccucugagcugaguugguuuu

SEQ ID NO: 2501 - RNA, 21 nt, Artificial Sequence
  source: /note="Description of Artificial Sequence: Synthetic oligonucleotide"
cucugagcugaguugguuuua

SEQ ID NO: 2502 - RNA, 21 nt, Artificial Sequence
  source: /note="Description of Artificial Sequence: Synthetic oligonucleotide"
ucugagcugaguugguuuuau

SEQ ID NO: 2503 - RNA, 21 nt, Artificial Sequence
  source: /note="Description of Artificial Sequence: Synthetic oligonucleotide"
cugagcugaguugguuuuauu

SEQ ID NO: 2504 - RNA, 21 nt, Artificial Sequence
  source: /note="Description of Artificial Sequence: Synthetic oligonucleotide"
ugagcugaguugguuuuauga

SEQ ID NO: 2505 - RNA, 21 nt, Artificial Sequence
  source: /note="Description of Artificial Sequence: Synthetic oligonucleotide"
gagcugaguugguuuuaugau

SEQ ID NO: 2506 - RNA, 21 nt, Artificial Sequence
  source: /note="Description of Artificial Sequence: Synthetic oligonucleotide"
agcugaguugguuuuaugaaa

SEQ ID NO: 2507 - RNA, 21 nt, Artificial Sequence
  source: /note="Description of Artificial Sequence: Synthetic oligonucleotide"
gcugaguugguuuuaugaaaa

SEQ ID NO: 2508 - RNA, 21 nt, Artificial Sequence
  source: /note="Description of Artificial Sequence: Synthetic oligonucleotide"
cugaguugguuuuaugaaaau

SEQ ID NO: 2509 - RNA, 21 nt, Artificial Sequence
  source: /note="Description of Artificial Sequence: Synthetic oligonucleotide"
ugaguugguuuuaugaaaagu

SEQ ID NO: 2510 - RNA, 21 nt, Artificial Sequence
  source: /note="Description of Artificial Sequence: Synthetic oligonucleotide"
gaguugguuuuaugaaaagcu

SEQ ID NO: 2511 - RNA, 21 nt, Artificial Sequence
  source: /note="Description of Artificial Sequence: Synthetic oligonucleotide"
aguugguuuuaugaaaagcua

SEQ ID NO: 2512 - RNA, 21 nt, Artificial Sequence
  source: /note="Description of Artificial Sequence: Synthetic oligonucleotide"
guugguuuuaugaaaagcuau

SEQ ID NO: 2513 - RNA, 21 nt, Artificial Sequence
  source: /note="Description of Artificial Sequence: Synthetic oligonucleotide"
uugguuuuaugaaaagcuagu

SEQ ID NO: 2514 - RNA, 21 nt, Artificial Sequence
  source: /note="Description of Artificial Sequence: Synthetic oligonucleotide"
ugguuuuaugaaaagcuagga

SEQ ID NO: 2515 - RNA, 21 nt, Artificial Sequence
  source: /note="Description of Artificial Sequence: Synthetic oligonucleotide"
gguuuuaugaaaagcuaggaa

SEQ ID NO: 2516 - RNA, 21 nt, Artificial Sequence
  source: /note="Description of Artificial Sequence: Synthetic oligonucleotide"
cugcaaagaugauaaccuuga

SEQ ID NO: 2517 - RNA, 21 nt, Artificial Sequence
  source: /note="Description of Artificial Sequence: Synthetic oligonucleotide"
ugcaaagaugauaaccuugau

SEQ ID NO: 2518 - RNA, 21 nt, Artificial Sequence
  source: /note="Description of Artificial Sequence: Synthetic oligonucleotide"
gcaaagaugauaaccuugacu

SEQ ID NO: 2519 - RNA, 21 nt, Artificial Sequence
  source: /note="Description of Artificial Sequence: Synthetic oligonucleotide"
caaagaugauaaccuugacua

SEQ ID NO: 2520 - RNA, 21 nt, Artificial Sequence
  source: /note="Description of Artificial Sequence: Synthetic oligonucleotide"
aaagaugauaaccuugacuau

SEQ ID NO: 2521 - RNA, 21 nt, Artificial Sequence
  source: /note="Description of Artificial Sequence: Synthetic oligonucleotide"
aagaugauaaccuugacuacu

SEQ ID NO: 2522 - RNA, 21 nt, Artificial Sequence
  source: /note="Description of Artificial Sequence: Synthetic oligonucleotide"
agaugauaaccuugacuacua

SEQ ID NO: 2523 - RNA, 21 nt, Artificial Sequence
  source: /note="Description of Artificial Sequence: Synthetic oligonucleotide"
gaugauaaccuugacuacuaa

SEQ ID NO: 2524 - RNA, 21 nt, Artificial Sequence
  source: /note="Description of Artificial Sequence: Synthetic oligonucleotide"
augauaaccuugacuacuaaa

SEQ ID NO: 2525 - RNA, 21 nt, Artificial Sequence
  source: /note="Description of Artificial Sequence: Synthetic oligonucleotide"
ugauaaccuugacuacuaaaa

SEQ ID NO: 2526 - RNA, 21 nt, Artificial Sequence
  source: /note="Description of Artificial Sequence: Synthetic oligonucleotide"
gauaaccuugacuacuaaaau

SEQ ID NO: 2527 - RNA, 21 nt, Artificial Sequence
  source: /note="Description of Artificial Sequence: Synthetic oligonucleotide"
auaaccuugacuacuaaaaau

SEQ ID NO: 2528 - RNA, 21 nt, Artificial Sequence
  source: /note="Description of Artificial Sequence: Synthetic oligonucleotide"
uaaccuugacuacuaaaaacu

SEQ ID NO: 2529 - RNA, 21 nt, Artificial Sequence
  source: /note="Description of Artificial Sequence: Synthetic oligonucleotide"
aaccuugacuacuaaaaacgu

SEQ ID NO: 2530 - RNA, 21 nt, Artificial Sequence
  source: /note="Description of Artificial Sequence: Synthetic oligonucleotide"
accuugacuacuaaaaacguu

SEQ ID NO: 2531 - RNA, 21 nt, Artificial Sequence
  source: /note="Description of Artificial Sequence: Synthetic oligonucleotide"
ccuugacuacuaaaaacgucu

SEQ ID NO: 2532 - RNA, 21 nt, Artificial Sequence
  source: /note="Description of Artificial Sequence: Synthetic oligonucleotide"
cuugacuacuaaaaacgucuu

SEQ ID NO: 2533 - RNA, 21 nt, Artificial Sequence
  source: /note="Description of Artificial Sequence: Synthetic oligonucleotide"
uugacuacuaaaaacgucucu

SEQ ID NO: 2534 - RNA, 21 nt, Artificial Sequence
  source: /note="Description of Artificial Sequence: Synthetic oligonucleotide"
ugacuacuaaaaacgucucca

SEQ ID NO: 2535 - RNA, 21 nt, Artificial Sequence
  source: /note="Description of Artificial Sequence: Synthetic oligonucleotide"
gacuacuaaaaacgucuccau

SEQ ID NO: 2536 - RNA, 21 nt, Artificial Sequence
  source: /note="Description of Artificial Sequence: Synthetic oligonucleotide"
acuacuaaaaacgucuccauu

SEQ ID NO: 2537 - RNA, 21 nt, Artificial Sequence
  source: /note="Description of Artificial Sequence: Synthetic oligonucleotide"
auuuuagaacaccuuuuucau

SEQ ID NO: 2538 - RNA, 21 nt, Artificial Sequence
  source: /note="Description of Artificial Sequence: Synthetic oligonucleotide"
uuuuagaacaccuuuuucacu

SEQ ID NO: 2539 - RNA, 21 nt, Artificial Sequence
  source: /note="Description of Artificial Sequence: Synthetic oligonucleotide"
uuuagaacaccuuuuucaccu

SEQ ID NO: 2540 - RNA, 21 nt, Artificial Sequence
  source: /note="Description of Artificial Sequence: Synthetic oligonucleotide"
uuagaacaccuuuuucaccua

SEQ ID NO: 2541 - RNA, 21 nt, Artificial Sequence
  source: /note="Description of Artificial Sequence: Synthetic oligonucleotide"
uagaacaccuuuuucaccuaa

SEQ ID NO: 2542 - RNA, 21 nt, Artificial Sequence
  source: /note="Description of Artificial Sequence: Synthetic oligonucleotide"
agaacaccuuuuucaccuaau

SEQ ID NO: 2543 - RNA, 21 nt, Artificial Sequence
  source: /note="Description of Artificial Sequence: Synthetic oligonucleotide"
gaacaccuuuuucaccuaacu

SEQ ID NO: 2544 - RNA, 21 nt, Artificial Sequence
  source: /note="Description of Artificial Sequence: Synthetic oligonucleotide"
aacaccuuuuucaccuaacua

SEQ ID NO: 2545 - RNA, 21 nt, Artificial Sequence
  source: /note="Description of Artificial Sequence: Synthetic oligonucleotide"
acaccuuuuucaccuaacuaa

SEQ ID NO: 2546 - RNA, 21 nt, Artificial Sequence
  source: /note="Description of Artificial Sequence: Synthetic oligonucleotide"
caccuuuuucaccuaacuaaa

SEQ ID NO: 2547 - RNA, 21 nt, Artificial Sequence
  source: /note="Description of Artificial Sequence: Synthetic oligonucleotide"
accuuuuucaccuaacuaaau

SEQ ID NO: 2548 - RNA, 21 nt, Artificial Sequence
  source: /note="Description of Artificial Sequence: Synthetic oligonucleotide"
ccuuuuucaccuaacuaaaau

SEQ ID NO: 2549 - RNA, 21 nt, Artificial Sequence
  source: /note="Description of Artificial Sequence: Synthetic oligonucleotide"
cuuuuucaccuaacuaaaaua

SEQ ID NO: 2550 - RNA, 21 nt, Artificial Sequence
  source: /note="Description of Artificial Sequence: Synthetic oligonucleotide"
uuuuucaccuaacuaaaauaa

SEQ ID NO: 2551 - RNA, 21 nt, Artificial Sequence
  source: /note="Description of Artificial Sequence: Synthetic oligonucleotide"
uuuucaccuaacuaaaauaau

SEQ ID NO: 2552 - RNA, 21 nt, Artificial Sequence
  source: /note="Description of Artificial Sequence: Synthetic oligonucleotide"
uuucaccuaacuaaaauaauu

SEQ ID NO: 2553 - RNA, 21 nt, Artificial Sequence
  source: /note="Description of Artificial Sequence: Synthetic oligonucleotide"
uucaccuaacuaaaauaaugu

SEQ ID NO: 2554 - RNA, 21 nt, Artificial Sequence
  source: /note="Description of Artificial Sequence: Synthetic oligonucleotide"
ucaccuaacuaaaauaauguu

SEQ ID NO: 2555 - RNA, 21 nt, Artificial Sequence
  source: /note="Description of Artificial Sequence: Synthetic oligonucleotide"
caccuaacuaaaauaauguuu

SEQ ID NO: 2556 - RNA, 21 nt, Artificial Sequence
  source: /note="Description of Artificial Sequence: Synthetic oligonucleotide"
accuaacuaaaauaauguuua

SEQ ID NO: 2557 - RNA, 21 nt, Artificial Sequence
  source: /note="Description of Artificial Sequence: Synthetic oligonucleotide"
ccuaacuaaaauaauguuuaa

SEQ ID NO: 2558 - RNA, 23 nt, Artificial Sequence
  source: /note="Description of Artificial Sequence: Synthetic oligonucleotide"
aacauuauccuaauggguagcaa

SEQ ID NO: 2559 - RNA, 23 nt, Artificial Sequence
  source: /note="Description of Artificial Sequence: Synthetic oligonucleotide"
agacauuauccuaauggguagca

SEQ ID NO: 2560 - RNA, 23 nt, Artificial Sequence
  source: /note="Description of Artificial Sequence: Synthetic oligonucleotide"
aagacauuauccuaauggguagc

SEQ ID NO: 2561 - RNA, 23 nt, Artificial Sequence
  source: /note="Description of Artificial Sequence: Synthetic oligonucleotide"
uaagacauuauccuaauggguag

SEQ ID NO: 2562 - RNA, 23 nt, Artificial Sequence
  source: /note="Description of Artificial Sequence: Synthetic oligonucleotide"
auaagacauuauccuaaugggua

SEQ ID NO: 2563 - RNA, 23 nt, Artificial Sequence
  source: /note="Description of Artificial Sequence: Synthetic oligonucleotide"
aauaagacauuauccuaaugggu

SEQ ID NO: 2564 - RNA, 23 nt, Artificial Sequence
  source: /note="Description of Artificial Sequence: Synthetic oligonucleotide"
acauaagacauuauccuaauggg

SEQ ID NO: 2565 - RNA, 23 nt, Artificial Sequence
  source: /note="Description of Artificial Sequence: Synthetic oligonucleotide"
uacauaagacauuauccuaaugg

SEQ ID NO: 2566 - RNA, 23 nt, Artificial Sequence
  source: /note="Description of Artificial Sequence: Synthetic oligonucleotide"
uuacauaagacauuauccuaaug

SEQ ID NO: 2567 - RNA, 23 nt, Artificial Sequence
  source: /note="Description of Artificial Sequence: Synthetic oligonucleotide"
auuacauaagacauuauccuaau

SEQ ID NO: 2568 - RNA, 23 nt, Artificial Sequence
  source: /note="Description of Artificial Sequence: Synthetic oligonucleotide"
aauuacauaagacauuauccuaa

SEQ ID NO: 2569 - RNA, 23 nt, Artificial Sequence
  source: /note="Description of Artificial Sequence: Synthetic oligonucleotide"
acauuacauaagacauuauccua

SEQ ID NO: 2570 - RNA, 23 nt, Artificial Sequence
  source: /note="Description of Artificial Sequence: Synthetic oligonucleotide"
agcauuacauaagacauuauccu

SEQ ID NO: 2571 - RNA, 23 nt, Artificial Sequence
  source: /note="Description of Artificial Sequence: Synthetic oligonucleotide"
aagcauuacauaagacauuaucc

SEQ ID NO: 2572 - RNA, 23 nt, Artificial Sequence
  source: /note="Description of Artificial Sequence: Synthetic oligonucleotide"
acagcauuacauaagacauuauc

SEQ ID NO: 2573 - RNA, 23 nt, Artificial Sequence
  source: /note="Description of Artificial Sequence: Synthetic oligonucleotide"
agcagcauuacauaagacauuau

SEQ ID NO: 2574 - RNA, 23 nt, Artificial Sequence
  source: /note="Description of Artificial Sequence: Synthetic oligonucleotide"
aggcagcauuacauaagacauua

SEQ ID NO: 2575 - RNA, 23 nt, Artificial Sequence
  source: /note="Description of Artificial Sequence: Synthetic oligonucleotide"
agggcagcauuacauaagacauu

SEQ ID NO: 2576 - RNA, 23 nt, Artificial Sequence
  source: /note="Description of Artificial Sequence: Synthetic oligonucleotide"
aagggcagcauuacauaagacau

SEQ ID NO: 2577 - RNA, 23 nt, Artificial Sequence
  source: /note="Description of Artificial Sequence: Synthetic oligonucleotide"
acagggcagcauuacauaagaca

SEQ ID NO: 2578 - RNA, 23 nt, Artificial Sequence
  source: /note="Description of Artificial Sequence: Synthetic oligonucleotide"
uacagggcagcauuacauaagac

SEQ ID NO: 2579 - RNA, 23 nt, Artificial Sequence
  source: /note="Description of Artificial Sequence: Synthetic oligonucleotide"
aaacucagcucagaggcugggau

SEQ ID NO: 2580 - RNA, 23 nt, Artificial Sequence
  source: /note="Description of Artificial Sequence: Synthetic oligonucleotide"
acaacucagcucagaggcuggga

SEQ ID NO: 2581 - RNA, 23 nt, Artificial Sequence
  source: /note="Description of Artificial Sequence: Synthetic oligonucleotide"
accaacucagcucagaggcuggg

SEQ ID NO: 2582 - RNA, 23 nt, Artificial Sequence
  source: /note="Description of Artificial Sequence: Synthetic oligonucleotide"
aaccaacucagcucagaggcugg

SEQ ID NO: 2583 - RNA, 23 nt, Artificial Sequence
  source: /note="Description of Artificial Sequence: Synthetic oligonucleotide"
aaaccaacucagcucagaggcug

SEQ ID NO: 2584 - RNA, 23 nt, Artificial Sequence
  source: /note="Description of Artificial Sequence: Synthetic oligonucleotide"
aaaaccaacucagcucagaggcu

SEQ ID NO: 2585 - RNA, 23 nt, Artificial Sequence
  source: /note="Description of Artificial Sequence: Synthetic oligonucleotide"
uaaaaccaacucagcucagaggc

SEQ ID NO: 2586 - RNA, 23 nt, Artificial Sequence
  source: /note="Description of Artificial Sequence: Synthetic oligonucleotide"
auaaaaccaacucagcucagagg

SEQ ID NO: 2587 - RNA, 23 nt, Artificial Sequence
  source: /note="Description of Artificial Sequence: Synthetic oligonucleotide"
aauaaaaccaacucagcucagag

SEQ ID NO: 2588 - RNA, 23 nt, Artificial Sequence
  source: /note="Description of Artificial Sequence: Synthetic oligonucleotide"
ucauaaaaccaacucagcucaga

SEQ ID NO: 2589 - RNA, 23 nt, Artificial Sequence
  source: /note="Description of Artificial Sequence: Synthetic oligonucleotide"
aucauaaaaccaacucagcucag

SEQ ID NO: 2590 - RNA, 23 nt, Artificial Sequence
  source: /note="Description of Artificial Sequence: Synthetic oligonucleotide"
uuucauaaaaccaacucagcuca

SEQ ID NO: 2591 - RNA, 23 nt, Artificial Sequence
  source: /note="Description of Artificial Sequence: Synthetic oligonucleotide"
uuuucauaaaaccaacucagcuc

SEQ ID NO: 2592 - RNA, 23 nt, Artificial Sequence
  source: /note="Description of Artificial Sequence: Synthetic oligonucleotide"
auuuucauaaaaccaacucagcu

SEQ ID NO: 2593 - RNA, 23 nt, Artificial Sequence
  source: /note="Description of Artificial Sequence: Synthetic oligonucleotide"
acuuuucauaaaaccaacucagc

SEQ ID NO: 2594 - RNA, 23 nt, Artificial Sequence
  source: /note="Description of Artificial Sequence: Synthetic oligonucleotide"
agcuuuucauaaaaccaacucag

SEQ ID NO: 2595 - RNA, 23 nt, Artificial Sequence
  source: /note="Description of Artificial Sequence: Synthetic oligonucleotide"
uagcuuuucauaaaaccaacuca

SEQ ID NO: 2596 - RNA, 23 nt, Artificial Sequence
  source: /note="Description of Artificial Sequence: Synthetic oligonucleotide"
auagcuuuucauaaaaccaacuc

SEQ ID NO: 2597 - RNA, 23 nt, Artificial Sequence
  source: /note="Description of Artificial Sequence: Synthetic oligonucleotide"
acuagcuuuucauaaaaccaacu

SEQ ID NO: 2598 - RNA, 23 nt, Artificial Sequence
  source: /note="Description of Artificial Sequence: Synthetic oligonucleotide"
uccuagcuuuucauaaaaccaac

SEQ ID NO: 2599 - RNA, 23 nt, Artificial Sequence
  source: /note="Description of Artificial Sequence: Synthetic oligonucleotide"
uuccuagcuuuucauaaaaccaa

SEQ ID NO: 2600 - RNA, 23 nt, Artificial Sequence
  source: /note="Description of Artificial Sequence: Synthetic oligonucleotide"
ucaagguuaucaucuuugcagac

SEQ ID NO: 2601 - RNA, 23 nt, Artificial Sequence
  source: /note="Description of Artificial Sequence: Synthetic oligonucleotide"
aucaagguuaucaucuuugcaga

SEQ ID NO: 2602 - RNA, 23 nt, Artificial Sequence
  source: /note="Description of Artificial Sequence: Synthetic oligonucleotide"
agucaagguuaucaucuuugcag

SEQ ID NO: 2603 - RNA, 23 nt, Artificial Sequence
  source: /note="Description of Artificial Sequence: Synthetic oligonucleotide"
uagucaagguuaucaucuuugca

SEQ ID NO: 2604 - RNA, 23 nt, Artificial Sequence
  source: /note="Description of Artificial Sequence: Synthetic oligonucleotide"
auagucaagguuaucaucuuugc

SEQ ID NO: 2605 - RNA, 23 nt, Artificial Sequence
  source: /note="Description of Artificial Sequence: Synthetic oligonucleotide"
aguagucaagguuaucaucuuug

SEQ ID NO: 2606 - RNA, 23 nt, Artificial Sequence
  source: /note="Description of Artificial Sequence: Synthetic oligonucleotide"
uaguagucaagguuaucaucuuu

SEQ ID NO: 2607 - RNA, 23 nt, Artificial Sequence
  source: /note="Description of Artificial Sequence: Synthetic oligonucleotide"
uuaguagucaagguuaucaucuu

SEQ ID NO: 2608 - RNA, 23 nt, Artificial Sequence
  source: /note="Description of Artificial Sequence: Synthetic oligonucleotide"
uuuaguagucaagguuaucaucu

SEQ ID NO: 2609 - RNA, 23 nt, Artificial Sequence
  source: /note="Description of Artificial Sequence: Synthetic oligonucleotide"
uuuuaguagucaagguuaucauc

SEQ ID NO: 2610 - RNA, 23 nt, Artificial Sequence
  source: /note="Description of Artificial Sequence: Synthetic oligonucleotide"
auuuuaguagucaagguuaucau

SEQ ID NO: 2611 - RNA, 23 nt, Artificial Sequence
  source: /note="Description of Artificial Sequence: Synthetic oligonucleotide"
auuuuuaguagucaagguuauca

SEQ ID NO: 2612 - RNA, 23 nt, Artificial Sequence
  source: /note="Description of Artificial Sequence: Synthetic oligonucleotide"
aguuuuuaguagucaagguuauc

SEQ ID NO: 2613 - RNA, 23 nt, Artificial Sequence
  source: /note="Description of Artificial Sequence: Synthetic oligonucleotide"
acguuuuuaguagucaagguuau

SEQ ID NO: 2614 - RNA, 23 nt, Artificial Sequence
  source: /note="Description of Artificial Sequence: Synthetic oligonucleotide"
aacguuuuuaguagucaagguua

SEQ ID NO: 2615 - RNA, 23 nt, Artificial Sequence
  source: /note="Description of Artificial Sequence: Synthetic oligonucleotide"
agacguuuuuaguagucaagguu

SEQ ID NO: 2616 - RNA, 23 nt, Artificial Sequence
  source: /note="Description of Artificial Sequence: Synthetic oligonucleotide"
aagacguuuuuaguagucaaggu

SEQ ID NO: 2617 - RNA, 23 nt, Artificial Sequence
  source: /note="Description of Artificial Sequence: Synthetic oligonucleotide"
agagacguuuuuaguagucaagg

SEQ ID NO: 2618 - RNA, 23 nt, Artificial Sequence
  source: /note="Description of Artificial Sequence: Synthetic oligonucleotide"
uggagacguuuuuaguagucaag

SEQ ID NO: 2619 - RNA, 23 nt, Artificial Sequence
  source: /note="Description of Artificial Sequence: Synthetic oligonucleotide"
auggagacguuuuuaguagucaa

SEQ ID NO: 2620 - RNA, 23 nt, Artificial Sequence
  source: /note="Description of Artificial Sequence: Synthetic oligonucleotide"
aauggagacguuuuuaguaguca

SEQ ID NO: 2621 - RNA, 23 nt, Artificial Sequence
  source: /note="Description of Artificial Sequence: Synthetic oligonucleotide"
augaaaaagguguucuaaaauua

SEQ ID NO: 2622 - RNA, 23 nt, Artificial Sequence
  source: /note="Description of Artificial Sequence: Synthetic oligonucleotide"
agugaaaaagguguucuaaaauu

SEQ ID NO: 2623 - RNA, 23 nt, Artificial Sequence
  source: /note="Description of Artificial Sequence: Synthetic oligonucleotide"
aggugaaaaagguguucuaaaau

SEQ ID NO: 2624 - RNA, 23 nt, Artificial Sequence
  source: /note="Description of Artificial Sequence: Synthetic oligonucleotide"
uaggugaaaaagguguucuaaaa

SEQ ID NO: 2625 - RNA, 23 nt, Artificial Sequence
  source: /note="Description of Artificial Sequence: Synthetic oligonucleotide"
uuaggugaaaaagguguucuaaa

SEQ ID NO: 2626 - RNA, 23 nt, Artificial Sequence
  source: /note="Description of Artificial Sequence: Synthetic oligonucleotide"
auuaggugaaaaagguguucuaa

SEQ ID NO: 2627 - RNA, 23 nt, Artificial Sequence
  source: /note="Description of Artificial Sequence: Synthetic oligonucleotide"
aguuaggugaaaaagguguucua

SEQ ID NO: 2628 - RNA, 23 nt, Artificial Sequence
  source: /note="Description of Artificial Sequence: Synthetic oligonucleotide"
uaguuaggugaaaaagguguucu

SEQ ID NO: 2629 - RNA, 23 nt, Artificial Sequence
  source: /note="Description of Artificial Sequence: Synthetic oligonucleotide"
uuaguuaggugaaaaagguguuc

SEQ ID NO: 2630 - RNA, 23 nt, Artificial Sequence
  source: /note="Description of Artificial Sequence: Synthetic oligonucleotide"
uuuaguuaggugaaaaagguguu

SEQ ID NO: 2631 - RNA, 23 nt, Artificial Sequence
  source: /note="Description of Artificial Sequence: Synthetic oligonucleotide"
auuuaguuaggugaaaaaggugu

SEQ ID NO: 2632 - RNA, 23 nt, Artificial Sequence
  source: /note="Description of Artificial Sequence: Synthetic oligonucleotide"
auuuuaguuaggugaaaaaggug

SEQ ID NO: 2633 - RNA, 23 nt, Artificial Sequence
  source: /note="Description of Artificial Sequence: Synthetic oligonucleotide"
uauuuuaguuaggugaaaaaggu

SEQ ID NO: 2634 - RNA, 23 nt, Artificial Sequence
  source: /note="Description of Artificial Sequence: Synthetic oligonucleotide"
uuauuuuaguuaggugaaaaagg

SEQ ID NO: 2635 - RNA, 23 nt, Artificial Sequence
  source: /note="Description of Artificial Sequence: Synthetic oligonucleotide"
auuauuuuaguuaggugaaaaag

SEQ ID NO: 2636 - RNA, 23 nt, Artificial Sequence
  source: /note="Description of Artificial Sequence: Synthetic oligonucleotide"
aauuauuuuaguuaggugaaaaa

SEQ ID NO: 2637 - RNA, 23 nt, Artificial Sequence
  source: /note="Description of Artificial Sequence: Synthetic oligonucleotide"
acauuauuuuaguuaggugaaaa

SEQ ID NO: 2638 - RNA, 23 nt, Artificial Sequence
  source: /note="Description of Artificial Sequence: Synthetic oligonucleotide"
aacauuauuuuaguuaggugaaa

SEQ ID NO: 2639 - RNA, 23 nt, Artificial Sequence
  source: /note="Description of Artificial Sequence: Synthetic oligonucleotide"
aaacauuauuuuaguuaggugaa

SEQ ID NO: 2640 - RNA, 23 nt, Artificial Sequence
  source: /note="Description of Artificial Sequence: Synthetic oligonucleotide"
uaaacauuauuuuaguuagguga

SEQ ID NO: 2641 - RNA, 23 nt, Artificial Sequence
  source: /note="Description of Artificial Sequence: Synthetic oligonucleotide"
uuaaacauuauuuuaguuaggug

SEQ ID NO: 2642 - RNA, 21 nt, Artificial Sequence
  source: /note="Description of Artificial Sequence: Synthetic oligonucleotide"
gcuacccauuaggauaauguu

SEQ ID NO: 2643 - RNA, 21 nt, Artificial Sequence
  source: /note="Description of Artificial Sequence: Synthetic oligonucleotide"
cuacccauuaggauaaugucu

SEQ ID NO: 2644 - RNA, 21 nt, Artificial Sequence
  source: /note="Description of Artificial Sequence: Synthetic oligonucleotide"
uacccauuaggauaaugucuu

SEQ ID NO: 2645 - RNA, 21 nt, Artificial Sequence
  source: /note="Description of Artificial Sequence: Synthetic oligonucleotide"
acccauuaggauaaugucuua

SEQ ID NO: 2646 - RNA, 21 nt, Artificial Sequence
  source: /note="Description of Artificial Sequence: Synthetic oligonucleotide"
cccauuaggauaaugucuuau

SEQ ID NO: 2647 - RNA, 21 nt, Artificial Sequence
  source: /note="Description of Artificial Sequence: Synthetic oligonucleotide"
ccauuaggauaaugucuuauu

SEQ ID NO: 2648 - RNA, 21 nt, Artificial Sequence
  source: /note="Description of Artificial Sequence: Synthetic oligonucleotide"
cauuaggauaaugucuuaugu

SEQ ID NO: 2649 - RNA, 21 nt, Artificial Sequence
  source: /note="Description of Artificial Sequence: Synthetic oligonucleotide"
auuaggauaaugucuuaugua

SEQ ID NO: 2650 - RNA, 21 nt, Artificial Sequence
  source: /note="Description of Artificial Sequence: Synthetic oligonucleotide"
uuaggauaaugucuuauguaa

SEQ ID NO: 2651 - RNA, 21 nt, Artificial Sequence
  source: /note="Description of Artificial Sequence: Synthetic oligonucleotide"
uaggauaaugucuuauguaau

SEQ ID NO: 2652 - RNA, 21 nt, Artificial Sequence
  source: /note="Description of Artificial Sequence: Synthetic oligonucleotide"
aggauaaugucuuauguaauu

SEQ ID NO: 2653 - RNA, 21 nt, Artificial Sequence
  source: /note="Description of Artificial Sequence: Synthetic oligonucleotide"
ggauaaugucuuauguaaugu

SEQ ID NO: 2654 - RNA, 21 nt, Artificial Sequence
  source: /note="Description of Artificial Sequence: Synthetic oligonucleotide"
gauaaugucuuauguaaugcu

SEQ ID NO: 2655 - RNA, 21 nt, Artificial Sequence
  source: /note="Description of Artificial Sequence: Synthetic oligonucleotide"
auaaugucuuauguaaugcuu

SEQ ID NO: 2656 - RNA, 21 nt, Artificial Sequence
  source: /note="Description of Artificial Sequence: Synthetic oligonucleotide"
uaaugucuuauguaaugcugu

SEQ ID NO: 2657 - RNA, 21 nt, Artificial Sequence
  source: /note="Description of Artificial Sequence: Synthetic oligonucleotide"
aaugucuuauguaaugcugcu

SEQ ID NO: 2658 - RNA, 21 nt, Artificial Sequence
  source: /note="Description of Artificial Sequence: Synthetic oligonucleotide"
augucuuauguaaugcugccu

SEQ ID NO: 2659 - RNA, 21 nt, Artificial Sequence
  source: /note="Description of Artificial Sequence: Synthetic oligonucleotide"
ugucuuauguaaugcugcccu

SEQ ID NO: 2660 - RNA, 21 nt, Artificial Sequence
  source: /note="Description of Artificial Sequence: Synthetic oligonucleotide"
gucuuauguaaugcugcccuu

SEQ ID NO: 2661 - RNA, 21 nt, Artificial Sequence
  source: /note="Description of Artificial Sequence: Synthetic oligonucleotide"
ucuuauguaaugcugcccugu

SEQ ID NO: 2662 - RNA, 21 nt, Artificial Sequence
  source: /note="Description of Artificial Sequence: Synthetic oligonucleotide"
cuuauguaaugcugcccugua

SEQ ID NO: 2663 - RNA, 21 nt, Artificial Sequence
  source: /note="Description of Artificial Sequence: Synthetic oligonucleotide"
cccagccucugagcugaguuu

SEQ ID NO: 2664 - RNA, 21 nt, Artificial Sequence
  source: /note="Description of Artificial Sequence: Synthetic oligonucleotide"
ccagccucugagcugaguugu

SEQ ID NO: 2665 - RNA, 21 nt, Artificial Sequence
  source: /note="Description of Artificial Sequence: Synthetic oligonucleotide"
cagccucugagcugaguuggu

SEQ ID NO: 2666 - RNA, 21 nt, Artificial Sequence
  source: /note="Description of Artificial Sequence: Synthetic oligonucleotide"
agccucugagcugaguugguu

SEQ ID NO: 2667 - RNA, 21 nt, Artificial Sequence
  source: /note="Description of Artificial Sequence: Synthetic oligonucleotide"
gccucugagcugaguugguuu

SEQ ID NO: 2668 - RNA, 21 nt, Artificial Sequence
  source: /note="Description of Artificial Sequence: Synthetic oligonucleotide"
ccucugagcugaguugguuuu

SEQ ID NO: 2669 - RNA, 21 nt, Artificial Sequence
  source: /note="Description of Artificial Sequence: Synthetic oligonucleotide"
cucugagcugaguugguuuua

SEQ ID NO: 2670 - RNA, 21 nt, Artificial Sequence
  source: /note="Description of Artificial Sequence: Synthetic oligonucleotide"
ucugagcugaguugguuuuau

SEQ ID NO: 2671 - RNA, 21 nt, Artificial Sequence
  source: /note="Description of Artificial Sequence: Synthetic oligonucleotide"
cugagcugaguugguuuuauu

SEQ ID NO: 2672 - RNA, 21 nt, Artificial Sequence
  source: /note="Description of Artificial Sequence: Synthetic oligonucleotide"
ugagcugaguugguuuuauga

SEQ ID NO: 2673 - RNA, 21 nt, Artificial Sequence
  source: /note="Description of Artificial Sequence: Synthetic oligonucleotide"
gagcugaguugguuuuaugau

SEQ ID NO: 2674 - RNA, 21 nt, Artificial Sequence
  source: /note="Description of Artificial Sequence: Synthetic oligonucleotide"
agcugaguugguuuuaugaaa

SEQ ID NO: 2675 - RNA, 21 nt, Artificial Sequence
  source: /note="Description of Artificial Sequence: Synthetic oligonucleotide"
gcugaguugguuuuaugaaaa

SEQ ID NO: 2676 - RNA, 21 nt, Artificial Sequence
  source: /note="Description of Artificial Sequence: Synthetic oligonucleotide"
cugaguugguuuuaugaaaau

SEQ ID NO: 2677 - RNA, 21 nt, Artificial Sequence
  source: /note="Description of Artificial Sequence: Synthetic oligonucleotide"
ugaguugguuuuaugaaaagu

SEQ ID NO: 2678 - RNA, 21 nt, Artificial Sequence
  source: /note="Description of Artificial Sequence: Synthetic oligonucleotide"
gaguugguuuuaugaaaagcu

SEQ ID NO: 2679 - RNA, 21 nt, Artificial Sequence
  source: /note="Description of Artificial Sequence: Synthetic oligonucleotide"
aguugguuuuaugaaaagcua

SEQ ID NO: 2680 - RNA, 21 nt, Artificial Sequence
  source: /note="Description of Artificial Sequence: Synthetic oligonucleotide"
guugguuuuaugaaaagcuau

SEQ ID NO: 2681 - RNA, 21 nt, Artificial Sequence
  source: /note="Description of Artificial Sequence: Synthetic oligonucleotide"
uugguuuuaugaaaagcuagu

SEQ ID NO: 2682 - RNA, 21 nt, Artificial Sequence
  source: /note="Description of Artificial Sequence: Synthetic oligonucleotide"
ugguuuuaugaaaagcuagga

SEQ ID NO: 2683 - RNA, 21 nt, Artificial Sequence
  source: /note="Description of Artificial Sequence: Synthetic oligonucleotide"
gguuuuaugaaaagcuaggaa

SEQ ID NO: 2684 - RNA, 21 nt, Artificial Sequence
  source: /note="Description of Artificial Sequence: Synthetic oligonucleotide"
cugcaaagaugauaaccuuga

SEQ ID NO: 2685 - RNA, 21 nt, Artificial Sequence
  source: /note="Description of Artificial Sequence: Synthetic oligonucleotide"
ugcaaagaugauaaccuugau

SEQ ID NO: 2686 - RNA, 21 nt, Artificial Sequence
  source: /note="Description of Artificial Sequence: Synthetic oligonucleotide"
gcaaagaugauaaccuugacu

SEQ ID NO: 2687 - RNA, 21 nt, Artificial Sequence
  source: /note="Description of Artificial Sequence: Synthetic oligonucleotide"
caaagaugauaaccuugacua

SEQ ID NO: 2688 - RNA, 21 nt, Artificial Sequence
  source: /note="Description of Artificial Sequence: Synthetic oligonucleotide"
aaagaugauaaccuugacuau

SEQ ID NO: 2689 - RNA, 21 nt, Artificial Sequence
  source: /note="Description of Artificial Sequence: Synthetic oligonucleotide"
aagaugauaaccuugacuacu

SEQ ID NO: 2690 - RNA, 21 nt, Artificial Sequence
  source: /note="Description of Artificial Sequence: Synthetic oligonucleotide"
agaugauaaccuugacuacua

SEQ ID NO: 2691 - RNA, 21 nt, Artificial Sequence
  source: /note="Description of Artificial Sequence: Synthetic oligonucleotide"
gaugauaaccuugacuacuaa

SEQ ID NO: 2692 - RNA, 21 nt, Artificial Sequence
  source: /note="Description of Artificial Sequence: Synthetic oligonucleotide"
augauaaccuugacuacuaaa

SEQ ID NO: 2693 - RNA, 21 nt, Artificial Sequence
  source: /note="Description of Artificial Sequence: Synthetic oligonucleotide"
ugauaaccuugacuacuaaaa

SEQ ID NO: 2694 - RNA, 21 nt, Artificial Sequence
  source: /note="Description of Artificial Sequence: Synthetic oligonucleotide"
gauaaccuugacuacuaaaau

SEQ ID NO: 2695 - RNA, 21 nt, Artificial Sequence
  source: /note="Description of Artificial Sequence: Synthetic oligonucleotide"
auaaccuugacuacuaaaaau

SEQ ID NO: 2696 - RNA, 21 nt, Artificial Sequence
  source: /note="Description of Artificial Sequence: Synthetic oligonucleotide"
uaaccuugacuacuaaaaacu

SEQ ID NO: 2697 - RNA, 21 nt, Artificial Sequence
  source: /note="Description of Artificial Sequence: Synthetic oligonucleotide"
aaccuugacuacuaaaaacgu

SEQ ID NO: 2698 - RNA, 21 nt, Artificial Sequence
  source: /note="Description of Artificial Sequence: Synthetic oligonucleotide"
accuugacuacuaaaaacguu

SEQ ID NO: 2699 - RNA, 21 nt, Artificial Sequence
  source: /note="Description of Artificial Sequence: Synthetic oligonucleotide"
ccuugacuacuaaaaacgucu

SEQ ID NO: 2700 - RNA, 21 nt, Artificial Sequence
  source: /note="Description of Artificial Sequence: Synthetic oligonucleotide"
cuugacuacuaaaaacgucuu

SEQ ID NO: 2701 - RNA, 21 nt, Artificial Sequence
  source: /note="Description of Artificial Sequence: Synthetic oligonucleotide"
uugacuacuaaaaacgucucu

SEQ ID NO: 2702 - RNA, 21 nt, Artificial Sequence
  source: /note="Description of Artificial Sequence: Synthetic oligonucleotide"
ugacuacuaaaaacgucucca

SEQ ID NO: 2703 - RNA, 21 nt, Artificial Sequence
  source: /note="Description of Artificial Sequence: Synthetic oligonucleotide"
gacuacuaaaaacgucuccau

SEQ ID NO: 2704 - RNA, 21 nt, Artificial Sequence
  source: /note="Description of Artificial Sequence: Synthetic oligonucleotide"
acuacuaaaaacgucuccauu

SEQ ID NO: 2705 - RNA, 21 nt, Artificial Sequence
  source: /note="Description of Artificial Sequence: Synthetic oligonucleotide"
auuuuagaacaccuuuuucau

SEQ ID NO: 2706 - RNA, 21 nt, Artificial Sequence
  source: /note="Description of Artificial Sequence: Synthetic oligonucleotide"
uuuuagaacaccuuuuucacu

SEQ ID NO: 2707 - RNA, 21 nt, Artificial Sequence
  source: /note="Description of Artificial Sequence: Synthetic oligonucleotide"
uuuagaacaccuuuuucaccu

SEQ ID NO: 2708 - RNA, 21 nt, Artificial Sequence
  source: /note="Description of Artificial Sequence: Synthetic oligonucleotide"
uuagaacaccuuuuucaccua

SEQ ID NO: 2709 - RNA, 21 nt, Artificial Sequence
  source: /note="Description of Artificial Sequence: Synthetic oligonucleotide"
uagaacaccuuuuucaccuaa

SEQ ID NO: 2710 - RNA, 21 nt, Artificial Sequence
  source: /note="Description of Artificial Sequence: Synthetic oligonucleotide"
agaacaccuuuuucaccuaau

SEQ ID NO: 2711 - RNA, 21 nt, Artificial Sequence
  source: /note="Description of Artificial Sequence: Synthetic oligonucleotide"
gaacaccuuuuucaccuaacu

SEQ ID NO: 2712 - RNA, 21 nt, Artificial Sequence
  source: /note="Description of Artificial Sequence: Synthetic oligonucleotide"
aacaccuuuuucaccuaacua

SEQ ID NO: 2713 - RNA, 21 nt, Artificial Sequence
  source: /note="Description of Artificial Sequence: Synthetic oligonucleotide"
acaccuuuuucaccuaacuaa

SEQ ID NO: 2714 - RNA, 21 nt, Artificial Sequence
  source: /note="Description of Artificial Sequence: Synthetic oligonucleotide"
caccuuuuucaccuaacuaaa

SEQ ID NO: 2715 - RNA, 21 nt, Artificial Sequence
  source: /note="Description of Artificial Sequence: Synthetic oligonucleotide"
accuuuuucaccuaacuaaau

SEQ ID NO: 2716 - RNA, 21 nt, Artificial Sequence
  source: /note="Description of Artificial Sequence: Synthetic oligonucleotide"
ccuuuuucaccuaacuaaaau

SEQ ID NO: 2717 - RNA, 21 nt, Artificial Sequence
  source: /note="Description of Artificial Sequence: Synthetic oligonucleotide"
cuuuuucaccuaacuaaaaua

SEQ ID NO: 2718 - RNA, 21 nt, Artificial Sequence
  source: /note="Description of Artificial Sequence: Synthetic oligonucleotide"
uuuuucaccuaacuaaaauaa

SEQ ID NO: 2719 - RNA, 21 nt, Artificial Sequence
  source: /note="Description of Artificial Sequence: Synthetic oligonucleotide"
uuuucaccuaacuaaaauaau

SEQ ID NO: 2720 - RNA, 21 nt, Artificial Sequence
  source: /note="Description of Artificial Sequence: Synthetic oligonucleotide"
uuucaccuaacuaaaauaauu

SEQ ID NO: 2721 - RNA, 21 nt, Artificial Sequence
  source: /note="Description of Artificial Sequence: Synthetic oligonucleotide"
uucaccuaacuaaaauaaugu

SEQ ID NO: 2722 - RNA, 21 nt, Artificial Sequence
  source: /note="Description of Artificial Sequence: Synthetic oligonucleotide"
ucaccuaacuaaaauaauguu

SEQ ID NO: 2723 - RNA, 21 nt, Artificial Sequence
  source: /note="Description of Artificial Sequence: Synthetic oligonucleotide"
caccuaacuaaaauaauguuu

SEQ ID NO: 2724 - RNA, 21 nt, Artificial Sequence
  source: /note="Description of Artificial Sequence: Synthetic oligonucleotide"
accuaacuaaaauaauguuua

SEQ ID NO: 2725 - RNA, 21 nt, Artificial Sequence
  source: /note="Description of Artificial Sequence: Synthetic oligonucleotide"
ccuaacuaaaauaauguuuaa

SEQ ID NO: 2726 - RNA, 23 nt, Artificial Sequence
  source: /note="Description of Artificial Sequence: Synthetic oligonucleotide"
aacauuauccuaauggguagcaa

SEQ ID NO: 2727 - RNA, 23 nt, Artificial Sequence
  source: /note="Description of Artificial Sequence: Synthetic oligonucleotide"
agacauuauccuaauggguagca

SEQ ID NO: 2728 - RNA, 23 nt, Artificial Sequence
  source: /note="Description of Artificial Sequence: Synthetic oligonucleotide"
aagacauuauccuaauggguagc

SEQ ID NO: 2729 - RNA, 23 nt, Artificial Sequence
  source: /note="Description of Artificial Sequence: Synthetic oligonucleotide"
uaagacauuauccuaauggguag

SEQ ID NO: 2730 - RNA, 23 nt, Artificial Sequence
  source: /note="Description of Artificial Sequence: Synthetic oligonucleotide"
auaagacauuauccuaaugggua

SEQ ID NO: 2731 - RNA, 23 nt, Artificial Sequence
  source: /note="Description of Artificial Sequence: Synthetic oligonucleotide"
aauaagacauuauccuaaugggu

SEQ ID NO: 2732 - RNA, 23 nt, Artificial Sequence
  source: /note="Description of Artificial Sequence: Synthetic oligonucleotide"
acauaagacauuauccuaauggg

SEQ ID NO: 2733 - RNA, 23 nt, Artificial Sequence
  source: /note="Description of Artificial Sequence: Synthetic oligonucleotide"
uacauaagacauuauccuaaugg

SEQ ID NO: 2734 - RNA, 23 nt, Artificial Sequence
  source: /note="Description of Artificial Sequence: Synthetic oligonucleotide"
uuacauaagacauuauccuaaug

SEQ ID NO: 2735 - RNA, 23 nt, Artificial Sequence
  source: /note="Description of Artificial Sequence: Synthetic oligonucleotide"
auuacauaagacauuauccuaau

SEQ ID NO: 2736 - RNA, 23 nt, Artificial Sequence
  source: /note="Description of Artificial Sequence: Synthetic oligonucleotide"
aauuacauaagacauuauccuaa

SEQ ID NO: 2737 - RNA, 23 nt, Artificial Sequence
  source: /note="Description of Artificial Sequence: Synthetic oligonucleotide"
acauuacauaagacauuauccua

SEQ ID NO: 2738 - RNA, 23 nt, Artificial Sequence
  source: /note="Description of Artificial Sequence: Synthetic oligonucleotide"
agcauuacauaagacauuauccu

SEQ ID NO: 2739 - RNA, 23 nt, Artificial Sequence
  source: /note="Description of Artificial Sequence: Synthetic oligonucleotide"
aagcauuacauaagacauuaucc

SEQ ID NO: 2740 - RNA, 23 nt, Artificial Sequence
  source: /note="Description of Artificial Sequence: Synthetic oligonucleotide"
acagcauuacauaagacauuauc

SEQ ID NO: 2741 - RNA, 23 nt, Artificial Sequence
  source: /note="Description of Artificial Sequence: Synthetic oligonucleotide"
agcagcauuacauaagacauuau

SEQ ID NO: 2742 - RNA, 23 nt, Artificial Sequence
  source: /note="Description of Artificial Sequence: Synthetic oligonucleotide"
aggcagcauuacauaagacauua

SEQ ID NO: 2743 - RNA, 23 nt, Artificial Sequence
  source: /note="Description of Artificial Sequence: Synthetic oligonucleotide"
agggcagcauuacauaagacauu

SEQ ID NO: 2744 - RNA, 23 nt, Artificial Sequence
  source: /note="Description of Artificial Sequence: Synthetic oligonucleotide"
aagggcagcauuacauaagacau

SEQ ID NO: 2745 - RNA, 23 nt, Artificial Sequence
  source: /note="Description of Artificial Sequence: Synthetic oligonucleotide"
acagggcagcauuacauaagaca

SEQ ID NO: 2746 - RNA, 23 nt, Artificial Sequence
  source: /note="Description of Artificial Sequence: Synthetic oligonucleotide"
uacagggcagcauuacauaagac

SEQ ID NO: 2747 - RNA, 23 nt, Artificial Sequence
  source: /note="Description of Artificial Sequence: Synthetic oligonucleotide"
aaacucagcucagaggcugggau

SEQ ID NO: 2748 - RNA, 23 nt, Artificial Sequence
  source: /note="Description of Artificial Sequence: Synthetic oligonucleotide"
acaacucagcucagaggcuggga

SEQ ID NO: 2749 - RNA, 23 nt, Artificial Sequence
  source: /note="Description of Artificial Sequence: Synthetic oligonucleotide"
accaacucagcucagaggcuggg

SEQ ID NO: 2750 - RNA, 23 nt, Artificial Sequence
  source: /note="Description of Artificial Sequence: Synthetic oligonucleotide"
aaccaacucagcucagaggcugg

SEQ ID NO: 2751 - RNA, 23 nt, Artificial Sequence
  source: /note="Description of Artificial Sequence: Synthetic oligonucleotide"
aaaccaacucagcucagaggcug

SEQ ID NO: 2752 - RNA, 23 nt, Artificial Sequence
  source: /note="Description of Artificial Sequence: Synthetic oligonucleotide"
aaaaccaacucagcucagaggcu

SEQ ID NO: 2753 - RNA, 23 nt, Artificial Sequence
  source: /note="Description of Artificial Sequence: Synthetic oligonucleotide"
uaaaaccaacucagcucagaggc

SEQ ID NO: 2754 - RNA, 23 nt, Artificial Sequence
  source: /note="Description of Artificial Sequence: Synthetic oligonucleotide"
auaaaaccaacucagcucagagg

SEQ ID NO: 2755 - RNA, 23 nt, Artificial Sequence
  source: /note="Description of Artificial Sequence: Synthetic oligonucleotide"
aauaaaaccaacucagcucagag

SEQ ID NO: 2756 - RNA, 23 nt, Artificial Sequence
  source: /note="Description of Artificial Sequence: Synthetic oligonucleotide"
ucauaaaaccaacucagcucaga

SEQ ID NO: 2757 - RNA, 23 nt, Artificial Sequence
  source: /note="Description of Artificial Sequence: Synthetic oligonucleotide"
aucauaaaaccaacucagcucag

SEQ ID NO: 2758 - RNA, 23 nt, Artificial Sequence
  source: /note="Description of Artificial Sequence: Synthetic oligonucleotide"
uuucauaaaaccaacucagcuca

SEQ ID NO: 2759 - RNA, 23 nt, Artificial Sequence
  source: /note="Description of Artificial Sequence: Synthetic oligonucleotide"
uuuucauaaaaccaacucagcuc

SEQ ID NO: 2760 - RNA, 23 nt, Artificial Sequence
  source: /note="Description of Artificial Sequence: Synthetic oligonucleotide"
auuuucauaaaaccaacucagcu

SEQ ID NO: 2761 - RNA, 23 nt, Artificial Sequence
  source: /note="Description of Artificial Sequence: Synthetic oligonucleotide"
acuuuucauaaaaccaacucagc

SEQ ID NO: 2762 - RNA, 23 nt, Artificial Sequence
  source: /note="Description of Artificial Sequence: Synthetic oligonucleotide"
agcuuuucauaaaaccaacucag

SEQ ID NO: 2763 - RNA, 23 nt, Artificial Sequence
  source: /note="Description of Artificial Sequence: Synthetic oligonucleotide"
uagcuuuucauaaaaccaacuca

SEQ ID NO: 2764 - RNA, 23 nt, Artificial Sequence
  source: /note="Description of Artificial Sequence: Synthetic oligonucleotide"
auagcuuuucauaaaaccaacuc

SEQ ID NO: 2765 - RNA, 23 nt, Artificial Sequence
  source: /note="Description of Artificial Sequence: Synthetic oligonucleotide"
acuagcuuuucauaaaaccaacu

SEQ ID NO: 2766 - RNA, 23 nt, Artificial Sequence
  source: /note="Description of Artificial Sequence: Synthetic oligonucleotide"
uccuagcuuuucauaaaaccaac

SEQ ID NO: 2767 - RNA, 23 nt, Artificial Sequence
  source: /note="Description of Artificial Sequence: Synthetic oligonucleotide"
uuccuagcuuuucauaaaaccaa

SEQ ID NO: 2768 - RNA, 23 nt, Artificial Sequence
  source: /note="Description of Artificial Sequence: Synthetic oligonucleotide"
ucaagguuaucaucuuugcagac

SEQ ID NO: 2769 - RNA, 23 nt, Artificial Sequence
  source: /note="Description of Artificial Sequence: Synthetic oligonucleotide"
aucaagguuaucaucuuugcaga

SEQ ID NO: 2770 - RNA, 23 nt, Artificial Sequence
  source: /note="Description of Artificial Sequence: Synthetic oligonucleotide"
agucaagguuaucaucuuugcag

SEQ ID NO: 2771 - RNA, 23 nt, Artificial Sequence
  source: /note="Description of Artificial Sequence: Synthetic oligonucleotide"
uagucaagguuaucaucuuugca

SEQ ID NO: 2772 - RNA, 23 nt, Artificial Sequence
  source: /note="Description of Artificial Sequence: Synthetic oligonucleotide"
auagucaagguuaucaucuuugc

SEQ ID NO: 2773 - RNA, 23 nt, Artificial Sequence
  source: /note="Description of Artificial Sequence: Synthetic oligonucleotide"
aguagucaagguuaucaucuuug

SEQ ID NO: 2774 - RNA, 23 nt, Artificial Sequence
  source: /note="Description of Artificial Sequence: Synthetic oligonucleotide"
uaguagucaagguuaucaucuuu

SEQ ID NO: 2775 - RNA, 23 nt, Artificial Sequence
  source: /note="Description of Artificial Sequence: Synthetic oligonucleotide"
uuaguagucaagguuaucaucuu

SEQ ID NO: 2776 - RNA, 23 nt, Artificial Sequence
  source: /note="Description of Artificial Sequence: Synthetic oligonucleotide"
uuuaguagucaagguuaucaucu

SEQ ID NO: 2777 - RNA, 23 nt, Artificial Sequence
  source: /note="Description of Artificial Sequence: Synthetic oligonucleotide"
uuuuaguagucaagguuaucauc

SEQ ID NO: 2778 - RNA, 23 nt, Artificial Sequence
  source: /note="Description of Artificial Sequence: Synthetic oligonucleotide"
auuuuaguagucaagguuaucau

SEQ ID NO: 2779 - RNA, 23 nt, Artificial Sequence
  source: /note="Description of Artificial Sequence: Synthetic oligonucleotide"
auuuuuaguagucaagguuauca

SEQ ID NO: 2780 - RNA, 23 nt, Artificial Sequence
  source: /note="Description of Artificial Sequence: Synthetic oligonucleotide"
aguuuuuaguagucaagguuauc

SEQ ID NO: 2781 - RNA, 23 nt, Artificial Sequence
  source: /note="Description of Artificial Sequence: Synthetic oligonucleotide"
acguuuuuaguagucaagguuau

SEQ ID NO: 2782 - RNA, 23 nt, Artificial Sequence
  source: /note="Description of Artificial Sequence: Synthetic oligonucleotide"
aacguuuuuaguagucaagguua

SEQ ID NO: 2783 - RNA, 23 nt, Artificial Sequence
  source: /note="Description of Artificial Sequence: Synthetic oligonucleotide"
agacguuuuuaguagucaagguu

SEQ ID NO: 2784 - RNA, 23 nt, Artificial Sequence
  source: /note="Description of Artificial Sequence: Synthetic oligonucleotide"
aagacguuuuuaguagucaaggu

SEQ ID NO: 2785 - RNA, 23 nt, Artificial Sequence
  source: /note="Description of Artificial Sequence: Synthetic oligonucleotide"
agagacguuuuuaguagucaagg

SEQ ID NO: 2786 - RNA, 23 nt, Artificial Sequence
  source: /note="Description of Artificial Sequence: Synthetic oligonucleotide"
uggagacguuuuuaguagucaag

SEQ ID NO: 2787 - RNA, 23 nt, Artificial Sequence
  source: /note="Description of Artificial Sequence: Synthetic oligonucleotide"
auggagacguuuuuaguagucaa

SEQ ID NO: 2788 - RNA, 23 nt, Artificial Sequence
  source: /note="Description of Artificial Sequence: Synthetic oligonucleotide"
aauggagacguuuuuaguaguca

SEQ ID NO: 2789 - RNA, 23 nt, Artificial Sequence
  source: /note="Description of Artificial Sequence: Synthetic oligonucleotide"
augaaaaagguguucuaaaauua

SEQ ID NO: 2790 - RNA, 23 nt, Artificial Sequence
  source: /note="Description of Artificial Sequence: Synthetic oligonucleotide"
agugaaaaagguguucuaaaauu

SEQ ID NO: 2791 - RNA, 23 nt, Artificial Sequence
  source: /note="Description of Artificial Sequence: Synthetic oligonucleotide"
aggugaaaaagguguucuaaaau

SEQ ID NO: 2792 - RNA, 23 nt, Artificial Sequence
  source: /note="Description of Artificial Sequence: Synthetic oligonucleotide"
uaggugaaaaagguguucuaaaa

SEQ ID NO: 2793 - RNA, 23 nt, Artificial Sequence
  source: /note="Description of Artificial Sequence: Synthetic oligonucleotide"
uuaggugaaaaagguguucuaaa

SEQ ID NO: 2794 - RNA, 23 nt, Artificial Sequence
  source: /note="Description of Artificial Sequence: Synthetic oligonucleotide"
auuaggugaaaaagguguucuaa

SEQ ID NO: 2795 - RNA, 23 nt, Artificial Sequence
  source: /note="Description of Artificial Sequence: Synthetic oligonucleotide"
aguuaggugaaaaagguguucua

SEQ ID NO: 2796 - RNA, 23 nt, Artificial Sequence
  source: /note="Description of Artificial Sequence: Synthetic oligonucleotide"
uaguuaggugaaaaagguguucu

SEQ ID NO: 2797 - RNA, 23 nt, Artificial Sequence
  source: /note="Description of Artificial Sequence: Synthetic oligonucleotide"
uuaguuaggugaaaaagguguuc

SEQ ID NO: 2798 - RNA, 23 nt, Artificial Sequence
  source: /note="Description of Artificial Sequence: Synthetic oligonucleotide"
uuuaguuaggugaaaaagguguu

SEQ ID NO: 2799 - RNA, 23 nt, Artificial Sequence
  source: /note="Description of Artificial Sequence: Synthetic oligonucleotide"
auuuaguuaggugaaaaaggugu

SEQ ID NO: 2800 - RNA, 23 nt, Artificial Sequence
  source: /note="Description of Artificial Sequence: Synthetic oligonucleotide"
auuuuaguuaggugaaaaaggug

SEQ ID NO: 2801 - RNA, 23 nt, Artificial Sequence
  source: /note="Description of Artificial Sequence: Synthetic oligonucleotide"
uauuuuaguuaggugaaaaaggu

SEQ ID NO: 2802 - RNA, 23 nt, Artificial Sequence
  source: /note="Description of Artificial Sequence: Synthetic oligonucleotide"
uuauuuuaguuaggugaaaaagg

SEQ ID NO: 2803 - RNA, 23 nt, Artificial Sequence
  source: /note="Description of Artificial Sequence: Synthetic oligonucleotide"
auuauuuuaguuaggugaaaaag

SEQ ID NO: 2804 - RNA, 23 nt, Artificial Sequence
  source: /note="Description of Artificial Sequence: Synthetic oligonucleotide"
aauuauuuuaguuaggugaaaaa

SEQ ID NO: 2805 - RNA, 23 nt, Artificial Sequence
  source: /note="Description of Artificial Sequence: Synthetic oligonucleotide"
acauuauuuuaguuaggugaaaa

SEQ ID NO: 2806 - RNA, 23 nt, Artificial Sequence
  source: /note="Description of Artificial Sequence: Synthetic oligonucleotide"
aacauuauuuuaguuaggugaaa

SEQ ID NO: 2807 - RNA, 23 nt, Artificial Sequence
  source: /note="Description of Artificial Sequence: Synthetic oligonucleotide"
aaacauuauuuuaguuaggugaa

SEQ ID NO: 2808 - RNA, 23 nt, Artificial Sequence
  source: /note="Description of Artificial Sequence: Synthetic oligonucleotide"
uaaacauuauuuuaguuagguga

SEQ ID NO: 2809 - RNA, 23 nt, Artificial Sequence
  source: /note="Description of Artificial Sequence: Synthetic oligonucleotide"
uuaaacauuauuuuaguuaggug

SEQ ID NO: 2810 - RNA, 23 nt, Artificial Sequence
  source: /note="Description of Artificial Sequence: Synthetic oligonucleotide"
uugcuacccauuaggauaauguc

SEQ ID NO: 2811 - RNA, 23 nt, Artificial Sequence
  source: /note="Description of Artificial Sequence: Synthetic oligonucleotide"
ugcuacccauuaggauaaugucu

SEQ ID NO: 2812 - RNA, 23 nt, Artificial Sequence
  source: /note="Description of Artificial Sequence: Synthetic oligonucleotide"
gcuacccauuaggauaaugucuu

SEQ ID NO: 2813 - RNA, 23 nt, Artificial Sequence
  source: /note="Description of Artificial Sequence: Synthetic oligonucleotide"
cuacccauuaggauaaugucuua

SEQ ID NO: 2814 - RNA, 23 nt, Artificial Sequence
  source: /note="Description of Artificial Sequence: Synthetic oligonucleotide"
uacccauuaggauaaugucuuau

SEQ ID NO: 2815 - RNA, 23 nt, Artificial Sequence
  source: /note="Description of Artificial Sequence: Synthetic oligonucleotide"
acccauuaggauaaugucuuaug

SEQ ID NO: 2816 - RNA, 23 nt, Artificial Sequence
  source: /note="Description of Artificial Sequence: Synthetic oligonucleotide"
cccauuaggauaaugucuuaugu

SEQ ID NO: 2817 - RNA, 23 nt, Artificial Sequence
  source: /note="Description of Artificial Sequence: Synthetic oligonucleotide"
ccauuaggauaaugucuuaugua

SEQ ID NO: 2818 - RNA, 23 nt, Artificial Sequence
  source: /note="Description of Artificial Sequence: Synthetic oligonucleotide"
cauuaggauaaugucuuauguaa

SEQ ID NO: 2819 - RNA, 23 nt, Artificial Sequence
  source: /note="Description of Artificial Sequence: Synthetic oligonucleotide"
auuaggauaaugucuuauguaau

SEQ ID NO: 2820 - RNA, 23 nt, Artificial Sequence
  source: /note="Description of Artificial Sequence: Synthetic oligonucleotide"
uuaggauaaugucuuauguaaug

SEQ ID NO: 2821 - RNA, 23 nt, Artificial Sequence
  source: /note="Description of Artificial Sequence: Synthetic oligonucleotide"
uaggauaaugucuuauguaaugc

SEQ ID NO: 2822 - RNA, 23 nt, Artificial Sequence
  source: /note="Description of Artificial Sequence: Synthetic oligonucleotide"
aggauaaugucuuauguaaugcu

SEQ ID NO: 2823 - RNA, 23 nt, Artificial Sequence
  source: /note="Description of Artificial Sequence: Synthetic oligonucleotide"
ggauaaugucuuauguaaugcug

SEQ ID NO: 2824 - RNA, 23 nt, Artificial Sequence
  source: /note="Description of Artificial Sequence: Synthetic oligonucleotide"
gauaaugucuuauguaaugcugc

SEQ ID NO: 2825 - RNA, 23 nt, Artificial Sequence
  source: /note="Description of Artificial Sequence: Synthetic oligonucleotide"
auaaugucuuauguaaugcugcc

SEQ ID NO: 2826 - RNA, 23 nt, Artificial Sequence
  source: /note="Description of Artificial Sequence: Synthetic oligonucleotide"
uaaugucuuauguaaugcugccc

SEQ ID NO: 2827 - RNA, 23 nt, Artificial Sequence
  source: /note="Description of Artificial Sequence: Synthetic oligonucleotide"
aaugucuuauguaaugcugcccu

SEQ ID NO: 2828 - RNA, 23 nt, Artificial Sequence
  source: /note="Description of Artificial Sequence: Synthetic oligonucleotide"
augucuuauguaaugcugcccug

SEQ ID NO: 2829 - RNA, 23 nt, Artificial Sequence
  source: /note="Description of Artificial Sequence: Synthetic oligonucleotide"
ugucuuauguaaugcugcccugu

SEQ ID NO: 2830 - RNA, 23 nt, Artificial Sequence
  source: /note="Description of Artificial Sequence: Synthetic oligonucleotide"
gucuuauguaaugcugcccugua

SEQ ID NO: 2831 - RNA, 23 nt, Artificial Sequence
  source: /note="Description of Artificial Sequence: Synthetic oligonucleotide"
aucccagccucugagcugaguug

SEQ ID NO: 2832 - RNA, 23 nt, Artificial Sequence
  source: /note="Description of Artificial Sequence: Synthetic oligonucleotide"
ucccagccucugagcugaguugg

SEQ ID NO: 2833 - RNA, 23 nt, Artificial Sequence
  source: /note="Description of Artificial Sequence: Synthetic oligonucleotide"
cccagccucugagcugaguuggu

SEQ ID NO: 2834 - RNA, 23 nt, Artificial Sequence
  source: /note="Description of Artificial Sequence: Synthetic oligonucleotide"
ccagccucugagcugaguugguu

SEQ ID NO: 2835 - RNA, 23 nt, Artificial Sequence
  source: /note="Description of Artificial Sequence: Synthetic oligonucleotide"
cagccucugagcugaguugguuu

SEQ ID NO: 2836 - RNA, 23 nt, Artificial Sequence
  source: /note="Description of Artificial Sequence: Synthetic oligonucleotide"
agccucugagcugaguugguuuu

SEQ ID NO: 2837 - RNA, 23 nt, Artificial Sequence
  source: /note="Description of Artificial Sequence: Synthetic oligonucleotide"
gccucugagcugaguugguuuua

SEQ ID NO: 2838 - RNA, 23 nt, Artificial Sequence
  source: /note="Description of Artificial Sequence: Synthetic oligonucleotide"
ccucugagcugaguugguuuuau

SEQ ID NO: 2839 - RNA, 23 nt, Artificial Sequence
  source: /note="Description of Artificial Sequence: Synthetic oligonucleotide"
cucugagcugaguugguuuuaug

SEQ ID NO: 2840 - RNA, 23 nt, Artificial Sequence
  source: /note="Description of Artificial Sequence: Synthetic oligonucleotide"
ucugagcugaguugguuuuauga

SEQ ID NO: 2841 - RNA, 23 nt, Artificial Sequence
  source: /note="Description of Artificial Sequence: Synthetic oligonucleotide"
cugagcugaguugguuuuaugaa

SEQ ID NO: 2842 - RNA, 23 nt, Artificial Sequence
  source: /note="Description of Artificial Sequence: Synthetic oligonucleotide"
ugagcugaguugguuuuaugaaa

SEQ ID NO: 2843 - RNA, 23 nt, Artificial Sequence
  source: /note="Description of Artificial Sequence: Synthetic oligonucleotide"
gagcugaguugguuuuaugaaaa

SEQ ID NO: 2844 - RNA, 23 nt, Artificial Sequence
  source: /note="Description of Artificial Sequence: Synthetic oligonucleotide"
agcugaguugguuuuaugaaaag

SEQ ID NO: 2845 - RNA, 23 nt, Artificial Sequence
  source: /note="Description of Artificial Sequence: Synthetic oligonucleotide"
gcugaguugguuuuaugaaaagc

SEQ ID NO: 2846 - RNA, 23 nt, Artificial Sequence
  source: /note="Description of Artificial Sequence: Synthetic oligonucleotide"
cugaguugguuuuaugaaaagcu

SEQ ID NO: 2847 - RNA, 23 nt, Artificial Sequence
  source: /note="Description of Artificial Sequence: Synthetic oligonucleotide"
ugaguugguuuuaugaaaagcua

SEQ ID NO: 2848 - RNA, 23 nt, Artificial Sequence
  source: /note="Description of Artificial Sequence: Synthetic oligonucleotide"
gaguugguuuuaugaaaagcuag

SEQ ID NO: 2849 - RNA, 23 nt, Artificial Sequence
  source: /note="Description of Artificial Sequence: Synthetic oligonucleotide"
aguugguuuuaugaaaagcuagg

SEQ ID NO: 2850 - RNA, 23 nt, Artificial Sequence
  source: /note="Description of Artificial Sequence: Synthetic oligonucleotide"
guugguuuuaugaaaagcuagga

SEQ ID NO: 2851 - RNA, 23 nt, Artificial Sequence
  source: /note="Description of Artificial Sequence: Synthetic oligonucleotide"
uugguuuuaugaaaagcuaggaa

SEQ ID NO: 2852 - RNA, 23 nt, Artificial Sequence
  source: /note="Description of Artificial Sequence: Synthetic oligonucleotide"
gucugcaaagaugauaaccuuga

SEQ ID NO: 2853 - RNA, 23 nt, Artificial Sequence
  source: /note="Description of Artificial Sequence: Synthetic oligonucleotide"
ucugcaaagaugauaaccuugac

SEQ ID NO: 2854 - RNA, 23 nt, Artificial Sequence
  source: /note="Description of Artificial Sequence: Synthetic oligonucleotide"
cugcaaagaugauaaccuugacu

SEQ ID NO: 2855 - RNA, 23 nt, Artificial Sequence
  source: /note="Description of Artificial Sequence: Synthetic oligonucleotide"
ugcaaagaugauaaccuugacua

SEQ ID NO: 2856 - RNA, 23 nt, Artificial Sequence
  source: /note="Description of Artificial Sequence: Synthetic oligonucleotide"
gcaaagaugauaaccuugacuac

SEQ ID NO: 2857 - RNA, 23 nt, Artificial Sequence
  source: /note="Description of Artificial Sequence: Synthetic oligonucleotide"
caaagaugauaaccuugacuacu

SEQ ID NO: 2858 - RNA, 23 nt, Artificial Sequence
  source: /note="Description of Artificial Sequence: Synthetic oligonucleotide"
aaagaugauaaccuugacuacua

SEQ ID NO: 2859 - RNA, 23 nt, Artificial Sequence
  source: /note="Description of Artificial Sequence: Synthetic oligonucleotide"
aagaugauaaccuugacuacuaa

SEQ ID NO: 2860 - RNA, 23 nt, Artificial Sequence
  source: /note="Description of Artificial Sequence: Synthetic oligonucleotide"
agaugauaaccuugacuacuaaa

SEQ ID NO: 2861 - RNA, 23 nt, Artificial Sequence
  source: /note="Description of Artificial Sequence: Synthetic oligonucleotide"
gaugauaaccuugacuacuaaaa

SEQ ID NO: 2862 - RNA, 23 nt, Artificial Sequence
  source: /note="Description of Artificial Sequence: Synthetic oligonucleotide"
augauaaccuugacuacuaaaaa

SEQ ID NO: 2863 - RNA, 23 nt, Artificial Sequence
  source: /note="Description of Artificial Sequence: Synthetic oligonucleotide"
ugauaaccuugacuacuaaaaac

SEQ ID NO: 2864 - RNA, 23 nt, Artificial Sequence
  source: /note="Description of Artificial Sequence: Synthetic oligonucleotide"
gauaaccuugacuacuaaaaacg

SEQ ID NO: 2865 - RNA, 23 nt, Artificial Sequence
  source: /note="Description of Artificial Sequence: Synthetic oligonucleotide"
auaaccuugacuacuaaaaacgu

SEQ ID NO: 2866 - RNA, 23 nt, Artificial Sequence
  source: /note="Description of Artificial Sequence: Synthetic oligonucleotide"
uaaccuugacuacuaaaaacguc

SEQ ID NO: 2867 - RNA, 23 nt, Artificial Sequence
  source: /note="Description of Artificial Sequence: Synthetic oligonucleotide"
aaccuugacuacuaaaaacgucu

SEQ ID NO: 2868 - RNA, 23 nt, Artificial Sequence
  source: /note="Description of Artificial Sequence: Synthetic oligonucleotide"
accuugacuacuaaaaacgucuc

SEQ ID NO: 2869 - RNA, 23 nt, Artificial Sequence
  source: /note="Description of Artificial Sequence: Synthetic oligonucleotide"
ccuugacuacuaaaaacgucucc

SEQ ID NO: 2870 - RNA, 23 nt, Artificial Sequence
  source: /note="Description of Artificial Sequence: Synthetic oligonucleotide"
cuugacuacuaaaaacgucucca

SEQ ID NO: 2871 - RNA, 23 nt, Artificial Sequence
  source: /note="Description of Artificial Sequence: Synthetic oligonucleotide"
uugacuacuaaaaacgucuccau

SEQ ID NO: 2872 - RNA, 23 nt, Artificial Sequence
  source: /note="Description of Artificial Sequence: Synthetic oligonucleotide"
ugacuacuaaaaacgucuccaug

SEQ ID NO: 2873 - RNA, 23 nt, Artificial Sequence
  source: /note="Description of Artificial Sequence: Synthetic oligonucleotide"
uaauuuuagaacaccuuuuucac

SEQ ID NO: 2874 - RNA, 23 nt, Artificial Sequence
  source: /note="Description of Artificial Sequence: Synthetic oligonucleotide"
aauuuuagaacaccuuuuucacc

SEQ ID NO: 2875 - RNA, 23 nt, Artificial Sequence
  source: /note="Description of Artificial Sequence: Synthetic oligonucleotide"
auuuuagaacaccuuuuucaccu

SEQ ID NO: 2876 - RNA, 23 nt, Artificial Sequence
  source: /note="Description of Artificial Sequence: Synthetic oligonucleotide"
uuuuagaacaccuuuuucaccua

SEQ ID NO: 2877 - RNA, 23 nt, Artificial Sequence
  source: /note="Description of Artificial Sequence: Synthetic oligonucleotide"
uuuagaacaccuuuuucaccuaa

SEQ ID NO: 2878 - RNA, 23 nt, Artificial Sequence
  source: /note="Description of Artificial Sequence: Synthetic oligonucleotide"
uuagaacaccuuuuucaccuaac

SEQ ID NO: 2879 - RNA, 23 nt, Artificial Sequence
  source: /note="Description of Artificial Sequence: Synthetic oligonucleotide"
uagaacaccuuuuucaccuaacu

SEQ ID NO: 2880 - RNA, 23 nt, Artificial Sequence
  source: /note="Description of Artificial Sequence: Synthetic oligonucleotide"
agaacaccuuuuucaccuaacua

SEQ ID NO: 2881 - RNA, 23 nt, Artificial Sequence
  source: /note="Description of Artificial Sequence: Synthetic oligonucleotide"
gaacaccuuuuucaccuaacuaa

SEQ ID NO: 2882 - RNA, 23 nt, Artificial Sequence
  source: /note="Description of Artificial Sequence: Synthetic oligonucleotide"
aacaccuuuuucaccuaacuaaa

SEQ ID NO: 2883 - RNA, 23 nt, Artificial Sequence
  source: /note="Description of Artificial Sequence: Synthetic oligonucleotide"
acaccuuuuucaccuaacuaaaa

SEQ ID NO: 2884 - RNA, 23 nt, Artificial Sequence
  source: /note="Description of Artificial Sequence: Synthetic oligonucleotide"
caccuuuuucaccuaacuaaaau

SEQ ID NO: 2885 - RNA, 23 nt, Artificial Sequence
  source: /note="Description of Artificial Sequence: Synthetic oligonucleotide"
accuuuuucaccuaacuaaaaua

SEQ ID NO: 2886 - RNA, 23 nt, Artificial Sequence
  source: /note="Description of Artificial Sequence: Synthetic oligonucleotide"
ccuuuuucaccuaacuaaaauaa

SEQ ID NO: 2887 - RNA, 23 nt, Artificial Sequence
  source: /note="Description of Artificial Sequence: Synthetic oligonucleotide"
cuuuuucaccuaacuaaaauaau

SEQ ID NO: 2888 - RNA, 23 nt, Artificial Sequence
  source: /note="Description of Artificial Sequence: Synthetic oligonucleotide"
uuuuucaccuaacuaaaauaaug

SEQ ID NO: 2889 - RNA, 23 nt, Artificial Sequence
  source: /note="Description of Artificial Sequence: Synthetic oligonucleotide"
uuuucaccuaacuaaaauaaugu

SEQ ID NO: 2890 - RNA, 23 nt, Artificial Sequence
  source: /note="Description of Artificial Sequence: Synthetic oligonucleotide"
uuucaccuaacuaaaauaauguu

SEQ ID NO: 2891 - RNA, 23 nt, Artificial Sequence
  source: /note="Description of Artificial Sequence: Synthetic oligonucleotide"
uucaccuaacuaaaauaauguuu

SEQ ID NO: 2892 - RNA, 23 nt, Artificial Sequence
  source: /note="Description of Artificial Sequence: Synthetic oligonucleotide"
ucaccuaacuaaaauaauguuua

SEQ ID NO: 2893 - RNA, 23 nt, Artificial Sequence
  source: /note="Description of Artificial Sequence: Synthetic oligonucleotide"
caccuaacuaaaauaauguuuaa

SEQ ID NO: 2894 - RNA, 21 nt, Artificial Sequence
  source: /note="Description of Artificial Sequence: Synthetic oligonucleotide"
ucugagcugaguugguuuuau

SEQ ID NO: 2895 - RNA, 21 nt, Artificial Sequence
  source: /note="Description of Artificial Sequence: Synthetic oligonucleotide"
ucugagcugaguugguuuuau

SEQ ID NO: 2896 - RNA, 21 nt, Artificial Sequence
  source: /note="Description of Artificial Sequence: Synthetic oligonucleotide"
ucugagcugaguugguuuuau

SEQ ID NO: 2897 - RNA, 21 nt, Artificial Sequence
  source: /note="Description of Artificial Sequence: Synthetic oligonucleotide"
ucugagcugaguugguuuuau

SEQ ID NO: 2898 - RNA, 21 nt, Artificial Sequence
  source: /note="Description of Artificial Sequence: Synthetic oligonucleotide"
ucugagcugaguugguuuuau

SEQ ID NO: 2899 - RNA, 19 nt, Artificial Sequence
  source: /note="Description of Artificial Sequence: Synthetic oligonucleotide"
ugagcugaguugguuuuau

SEQ ID NO: 2900 - RNA, 19 nt, Artificial Sequence
  source: /note="Description of Artificial Sequence: Synthetic oligonucleotide"
ugagcugaguugguuuuau

SEQ ID NO: 2901 - RNA, 21 nt, Artificial Sequence
  source: /note="Description of Artificial Sequence: Synthetic oligonucleotide"
ucugagcugaguugguuuuau

SEQ ID NO: 2902 - RNA, 21 nt, Artificial Sequence
  source: /note="Description of Artificial Sequence: Synthetic oligonucleotide"
ucugagcugaguugguuuuau

SEQ ID NO: 2903 - RNA, 21 nt, Artificial Sequence
  source: /note="Description of Artificial Sequence: Synthetic oligonucleotide"
ucugagcugaguugguuuuau

SEQ ID NO: 2904 - RNA, 21 nt, Artificial Sequence
  source: /note="Description of Artificial Sequence: Synthetic oligonucleotide"
ucugagcugaguugguuuuau

SEQ ID NO: 2905 - RNA, 21 nt, Artificial Sequence
  source: /note="Description of Artificial Sequence: Synthetic oligonucleotide"
ucugagcugaguugguuuuau

SEQ ID NO: 2906 - RNA, 21 nt, Artificial Sequence
  source: /note="Description of Artificial Sequence: Synthetic oligonucleotide"
ucugagcugaguugguuuuau

SEQ ID NO: 2907 - RNA, 21 nt, Artificial Sequence
  source: /note="Description of Artificial Sequence: Synthetic oligonucleotide"
ucugagcugaguugguuuuau

SEQ ID NO: 2908 - RNA, 21 nt, Artificial Sequence
  source: /note="Description of Artificial Sequence: Synthetic oligonucleotide"
ucugagcugaguugguuuuau

SEQ ID NO: 2909 - RNA, 21 nt, Artificial Sequence
  source: /note="Description of Artificial Sequence: Synthetic oligonucleotide"
ucugagcugaguugguuuuau

SEQ ID NO: 2910 - RNA, 19 nt, Artificial Sequence
  source: /note="Description of Artificial Sequence: Synthetic oligonucleotide"
ugagcugaguugguuuuau

SEQ ID NO: 2911 - RNA, 19 nt, Artificial Sequence
  source: /note="Description of Artificial Sequence: Synthetic oligonucleotide"
ugagcugaguugguuuuau

SEQ ID NO: 2912 - RNA, 19 nt, Artificial Sequence
  source: /note="Description of Artificial Sequence: Synthetic oligonucleotide"
ugagcugaguugguuuuau

SEQ ID NO: 2913 - RNA, 21 nt, Artificial Sequence
  source: /note="Description of Artificial Sequence: Synthetic oligonucleotide"
ucugagcugaguugguuuuau

SEQ ID NO: 2914 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguuggutuuau

SEQ ID NO: 2915 - RNA, 21 nt, Artificial Sequence
  source: /note="Description of Artificial Sequence: Synthetic oligonucleotide"
ccauuaggauaaugucuuauu

SEQ ID NO: 2916 - RNA, 21 nt, Artificial Sequence
  source: /note="Description of Artificial Sequence: Synthetic oligonucleotide"
ccauuaggauaaugucuuauu

SEQ ID NO: 2917 - RNA, 21 nt, Artificial Sequence
  source: /note="Description of Artificial Sequence: Synthetic oligonucleotide"
ccauuaggauaaugucuuauu

SEQ ID NO: 2918 - RNA, 21 nt, Artificial Sequence
  source: /note="Description of Artificial Sequence: Synthetic oligonucleotide"
ccauuaggauaaugucuuauu

SEQ ID NO: 2919 - RNA, 21 nt, Artificial Sequence
  source: /note="Description of Artificial Sequence: Synthetic oligonucleotide"
ccauuaggauaaugucuuauu

SEQ ID NO: 2920 - RNA, 21 nt, Artificial Sequence
  source: /note="Description of Artificial Sequence: Synthetic oligonucleotide"
ccauuaggauaaugucuuauu

SEQ ID NO: 2921 - RNA, 21 nt, Artificial Sequence
  source: /note="Description of Artificial Sequence: Synthetic oligonucleotide"
ccauuaggauaaugucuuauu

SEQ ID NO: 2922 - RNA, 21 nt, Artificial Sequence
  source: /note="Description of Artificial Sequence: Synthetic oligonucleotide"
ccauuaggauaaugucuuauu

SEQ ID NO: 2923 - RNA, 21 nt, Artificial Sequence
  source: /note="Description of Artificial Sequence: Synthetic oligonucleotide"
ccauuaggauaaugucuuauu

SEQ ID NO: 2924 - RNA, 19 nt, Artificial Sequence
  source: /note="Description of Artificial Sequence: Synthetic oligonucleotide"
auuaggauaaugucuuauu

SEQ ID NO: 2925 - RNA, 19 nt, Artificial Sequence
  source: /note="Description of Artificial Sequence: Synthetic oligonucleotide"
auuaggauaaugucuuauu

SEQ ID NO: 2926 - RNA, 21 nt, Artificial Sequence
  source: /note="Description of Artificial Sequence: Synthetic oligonucleotide"
ccauuaggauaaugucuuauu

SEQ ID NO: 2927 - RNA, 21 nt, Artificial Sequence
  source: /note="Description of Artificial Sequence: Synthetic oligonucleotide"
ccauuaggauaaugucuuauu

SEQ ID NO: 2928 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauuaggauaauguctuauu

SEQ ID NO: 2929 - RNA, 21 nt, Artificial Sequence
  source: /note="Description of Artificial Sequence: Synthetic oligonucleotide"
cauuaggauaaugucuuaugu

SEQ ID NO: 2930 - RNA, 21 nt, Artificial Sequence
  source: /note="Description of Artificial Sequence: Synthetic oligonucleotide"
cauuaggauaaugucuuaugu

SEQ ID NO: 2931 - RNA, 21 nt, Artificial Sequence
  source: /note="Description of Artificial Sequence: Synthetic oligonucleotide"
cauuaggauaaugucuuaugu

SEQ ID NO: 2932 - RNA, 21 nt, Artificial Sequence
  source: /note="Description of Artificial Sequence: Synthetic oligonucleotide"
cauuaggauaaugucuuaugu

SEQ ID NO: 2933 - RNA, 21 nt, Artificial Sequence
  source: /note="Description of Artificial Sequence: Synthetic oligonucleotide"
cauuaggauaaugucuuaugu

SEQ ID NO: 2934 - RNA, 19 nt, Artificial Sequence
  source: /note="Description of Artificial Sequence: Synthetic oligonucleotide"
uuaggauaaugucuuaugu

SEQ ID NO: 2935 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuaggataaugucuuaugu

SEQ ID NO: 2936 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuaggataaugucutaugu

SEQ ID NO: 2937 - RNA, 21 nt, Artificial Sequence
  source: /note="Description of Artificial Sequence: Synthetic oligonucleotide"
cauuaggauaaugucuuaugu

SEQ ID NO: 2938 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuaggauaaugucutaugu

SEQ ID NO: 2939 - RNA, 21 nt, Artificial Sequence
  source: /note="Description of Artificial Sequence: Synthetic oligonucleotide"
uaggauaaugucuuauguaau

SEQ ID NO: 2940 - RNA, 21 nt, Artificial Sequence
  source: /note="Description of Artificial Sequence: Synthetic oligonucleotide"
uaggauaaugucuuauguaau

SEQ ID NO: 2941 - RNA, 21 nt, Artificial Sequence
  source: /note="Description of Artificial Sequence: Synthetic oligonucleotide"
uaggauaaugucuuauguaau

SEQ ID NO: 2942 - RNA, 21 nt, Artificial Sequence
  source: /note="Description of Artificial Sequence: Synthetic oligonucleotide"
uaggauaaugucuuauguaau

SEQ ID NO: 2943 - RNA, 21 nt, Artificial Sequence
  source: /note="Description of Artificial Sequence: Synthetic oligonucleotide"
uaggauaaugucuuauguaau

SEQ ID NO: 2944 - RNA, 21 nt, Artificial Sequence
  source: /note="Description of Artificial Sequence: Synthetic oligonucleotide"
uaggauaaugucuuauguaau

SEQ ID NO: 2945 - RNA, 21 nt, Artificial Sequence
  source: /note="Description of Artificial Sequence: Synthetic oligonucleotide"
uaggauaaugucuuauguaau

SEQ ID NO: 2946 - RNA, 21 nt, Artificial Sequence
  source: /note="Description of Artificial Sequence: Synthetic oligonucleotide"
uaggauaaugucuuauguaau

SEQ ID NO: 2947 - RNA, 21 nt, Artificial Sequence
  source: /note="Description of Artificial Sequence: Synthetic oligonucleotide"
uaggauaaugucuuauguaau

SEQ ID NO: 2948 - RNA, 21 nt, Artificial Sequence
  source: /note="Description of Artificial Sequence: Synthetic oligonucleotide"
uaggauaaugucuuauguaau

SEQ ID NO: 2949 - RNA, 21 nt, Artificial Sequence
  source: /note="Description of Artificial Sequence: Synthetic oligonucleotide"
uaggauaaugucuuauguaau

SEQ ID NO: 2950 - RNA, 21 nt, Artificial Sequence
  source: /note="Description of Artificial Sequence: Synthetic oligonucleotide"
uaggauaaugucuuauguaau

SEQ ID NO: 2951 - RNA, 21 nt, Artificial Sequence
  source: /note="Description of Artificial Sequence: Synthetic oligonucleotide"
uaggauaaugucuuauguaau

SEQ ID NO: 2952 - RNA, 21 nt, Artificial Sequence
  source: /note="Description of Artificial Sequence: Synthetic oligonucleotide"
uaggauaaugucuuauguaau

SEQ ID NO: 2953 - RNA, 21 nt, Artificial Sequence
  source: /note="Description of Artificial Sequence: Synthetic oligonucleotide"
uaggauaaugucuuauguaau

SEQ ID NO: 2954 - RNA, 21 nt, Artificial Sequence
  source: /note="Description of Artificial Sequence: Synthetic oligonucleotide"
cugaguugguuuuaugaaaau

SEQ ID NO: 2955 - RNA, 21 nt, Artificial Sequence
  source: /note="Description of Artificial Sequence: Synthetic oligonucleotide"
cugaguugguuuuaugaaaau

SEQ ID NO: 2956 - RNA, 21 nt, Artificial Sequence
  source: /note="Description of Artificial Sequence: Synthetic oligonucleotide"
cugaguugguuuuaugaaaau

SEQ ID NO: 2957 - RNA, 21 nt, Artificial Sequence
  source: /note="Description of Artificial Sequence: Synthetic oligonucleotide"
cugaguugguuuuaugaaaau

SEQ ID NO: 2958 - RNA, 21 nt, Artificial Sequence
  source: /note="Description of Artificial Sequence: Synthetic oligonucleotide"
cugaguugguuuuaugaaaau

SEQ ID NO: 2959 - RNA, 21 nt, Artificial Sequence
  source: /note="Description of Artificial Sequence: Synthetic oligonucleotide"
cugaguugguuuuaugaaaau

SEQ ID NO: 2960 - RNA, 21 nt, Artificial Sequence
  source: /note="Description of Artificial Sequence: Synthetic oligonucleotide"
cugaguugguuuuaugaaaau

SEQ ID NO: 2961 - RNA, 21 nt, Artificial Sequence
  source: /note="Description of Artificial Sequence: Synthetic oligonucleotide"
cugaguugguuuuaugaaaau

SEQ ID NO: 2962 - RNA, 21 nt, Artificial Sequence
  source: /note="Description of Artificial Sequence: Synthetic oligonucleotide"
cugaguugguuuuaugaaaau

SEQ ID NO: 2963 - RNA, 21 nt, Artificial Sequence
  source: /note="Description of Artificial Sequence: Synthetic oligonucleotide"
cugaguugguuuuaugaaaau

SEQ ID NO: 2964 - RNA, 21 nt, Artificial Sequence
  source: /note="Description of Artificial Sequence: Synthetic oligonucleotide"
cugaguugguuuuaugaaaau

SEQ ID NO: 2965 - RNA, 19 nt, Artificial Sequence
  source: /note="Description of Artificial Sequence: Synthetic oligonucleotide"
gaguugguuuuaugaaaau

SEQ ID NO: 2966 - RNA, 19 nt, Artificial Sequence
  source: /note="Description of Artificial Sequence: Synthetic oligonucleotide"
gaguugguuuuaugaaaau

SEQ ID NO: 2967 - RNA, 21 nt, Artificial Sequence
  source: /note="Description of Artificial Sequence: Synthetic oligonucleotide"
cugaguugguuuuaugaaaau

SEQ ID NO: 2968 - RNA, 21 nt, Artificial Sequence
  source: /note="Description of Artificial Sequence: Synthetic oligonucleotide"
cugaguugguuuuaugaaaau

SEQ ID NO: 2969 - RNA, 21 nt, Artificial Sequence
  source: /note="Description of Artificial Sequence: Synthetic oligonucleotide"
cugaguugguuuuaugaaaau

SEQ ID NO: 2970 - RNA, 21 nt, Artificial Sequence
  source: /note="Description of Artificial Sequence: Synthetic oligonucleotide"
cugaguugguuuuaugaaaau

SEQ ID NO: 2971 - RNA, 21 nt, Artificial Sequence
  source: /note="Description of Artificial Sequence: Synthetic oligonucleotide"
cugaguugguuuuaugaaaau

SEQ ID NO: 2972 - RNA, 19 nt, Artificial Sequence
  source: /note="Description of Artificial Sequence: Synthetic oligonucleotide"
gaguugguuuuaugaaaau

SEQ ID NO: 2973 - RNA, 19 nt, Artificial Sequence
  source: /note="Description of Artificial Sequence: Synthetic oligonucleotide"
gaguugguuuuaugaaaau

SEQ ID NO: 2974 - RNA, 21 nt, Artificial Sequence
  source: /note="Description of Artificial Sequence: Synthetic oligonucleotide"
gauaaccuugacuacuaaaau

SEQ ID NO: 2975 - RNA, 21 nt, Artificial Sequence
  source: /note="Description of Artificial Sequence: Synthetic oligonucleotide"
gauaaccuugacuacuaaaau

SEQ ID NO: 2976 - RNA, 21 nt, Artificial Sequence
  source: /note="Description of Artificial Sequence: Synthetic oligonucleotide"
gauaaccuugacuacuaaaau

SEQ ID NO: 2977 - RNA, 21 nt, Artificial Sequence
  source: /note="Description of Artificial Sequence: Synthetic oligonucleotide"
gauaaccuugacuacuaaaau

SEQ ID NO: 2978 - RNA, 21 nt, Artificial Sequence
  source: /note="Description of Artificial Sequence: Synthetic oligonucleotide"
gauaaccuugacuacuaaaau

SEQ ID NO: 2979 - RNA, 21 nt, Artificial Sequence
  source: /note="Description of Artificial Sequence: Synthetic oligonucleotide"
gauaaccuugacuacuaaaau

SEQ ID NO: 2980 - RNA, 21 nt, Artificial Sequence
  source: /note="Description of Artificial Sequence: Synthetic oligonucleotide"
gauaaccuugacuacuaaaau

SEQ ID NO: 2981 - RNA, 21 nt, Artificial Sequence
  source: /note="Description of Artificial Sequence: Synthetic oligonucleotide"
gauaaccuugacuacuaaaau

SEQ ID NO: 2982 - RNA, 21 nt, Artificial Sequence
  source: /note="Description of Artificial Sequence: Synthetic oligonucleotide"
gauaaccuugacuacuaaaau

SEQ ID NO: 2983 - RNA, 21 nt, Artificial Sequence
  source: /note="Description of Artificial Sequence: Synthetic oligonucleotide"
gauaaccuugacuacuaaaau

SEQ ID NO: 2984 - RNA, 21 nt, Artificial Sequence
  source: /note="Description of Artificial Sequence: Synthetic oligonucleotide"
gauaaccuugacuacuaaaau

SEQ ID NO: 2985 - RNA, 21 nt, Artificial Sequence
  source: /note="Description of Artificial Sequence: Synthetic oligonucleotide"
gauaaccuugacuacuaaaau

SEQ ID NO: 2986 - RNA, 21 nt, Artificial Sequence
  source: /note="Description of Artificial Sequence: Synthetic oligonucleotide"
gauaaccuugacuacuaaaau

SEQ ID NO: 2987 - RNA, 21 nt, Artificial Sequence
  source: /note="Description of Artificial Sequence: Synthetic oligonucleotide"
gauaaccuugacuacuaaaau

SEQ ID NO: 2988 - RNA, 19 nt, Artificial Sequence
  source: /note="Description of Artificial Sequence: Synthetic oligonucleotide"
uaaccuugacuacuaaaau

SEQ ID NO: 2989 - RNA, 19 nt, Artificial Sequence
  source: /note="Description of Artificial Sequence: Synthetic oligonucleotide"
uaaccuugacuacuaaaau

SEQ ID NO: 2990 - RNA, 19 nt, Artificial Sequence
  source: /note="Description of Artificial Sequence: Synthetic oligonucleotide"
uaaccuugacuacuaaaau

SEQ ID NO: 2991 - RNA, 21 nt, Artificial Sequence
  source: /note="Description of Artificial Sequence: Synthetic oligonucleotide"
uuuuagaacaccuuuuucacu

SEQ ID NO: 2992 - RNA, 21 nt, Artificial Sequence
  source: /note="Description of Artificial Sequence: Synthetic oligonucleotide"
uuuuagaacaccuuuuucacu

SEQ ID NO: 2993 - RNA, 21 nt, Artificial Sequence
  source: /note="Description of Artificial Sequence: Synthetic oligonucleotide"
uuuuagaacaccuuuuucacu

SEQ ID NO: 2994 - RNA, 21 nt, Artificial Sequence
  source: /note="Description of Artificial Sequence: Synthetic oligonucleotide"
uuuuagaacaccuuuuucacu

SEQ ID NO: 2995 - RNA, 21 nt, Artificial Sequence
  source: /note="Description of Artificial Sequence: Synthetic oligonucleotide"
uuuuagaacaccuuuuucacu

SEQ ID NO: 2996 - RNA, 21 nt, Artificial Sequence
  source: /note="Description of Artificial Sequence: Synthetic oligonucleotide"
uuuuagaacaccuuuuucacu

SEQ ID NO: 2997 - RNA, 21 nt, Artificial Sequence
  source: /note="Description of Artificial Sequence: Synthetic oligonucleotide"
uuuuagaacaccuuuuucacu

SEQ ID NO: 2998 - RNA, 21 nt, Artificial Sequence
  source: /note="Description of Artificial Sequence: Synthetic oligonucleotide"
uuuuagaacaccuuuuucacu

SEQ ID NO: 2999 - RNA, 21 nt, Artificial Sequence
  source: /note="Description of Artificial Sequence: Synthetic oligonucleotide"
uuuuagaacaccuuuuucacu

SEQ ID NO: 3000 - RNA, 21 nt, Artificial Sequence
  source: /note="Description of Artificial Sequence: Synthetic oligonucleotide"
uuuuagaacaccuuuuucacu

SEQ ID NO: 3001 - RNA, 21 nt, Artificial Sequence
  source: /note="Description of Artificial Sequence: Synthetic oligonucleotide"
uuuuagaacaccuuuuucacu

SEQ ID NO: 3002 - RNA, 21 nt, Artificial Sequence
  source: /note="Description of Artificial Sequence: Synthetic oligonucleotide"
uuuuagaacaccuuuuucacu

SEQ ID NO: 3003 - RNA, 21 nt, Artificial Sequence
  source: /note="Description of Artificial Sequence: Synthetic oligonucleotide"
uuuuagaacaccuuuuucacu

SEQ ID NO: 3004 - RNA, 21 nt, Artificial Sequence
  source: /note="Description of Artificial Sequence: Synthetic oligonucleotide"
uuuuagaacaccuuuuucacu

SEQ ID NO: 3005 - RNA, 21 nt, Artificial Sequence
  source: /note="Description of Artificial Sequence: Synthetic oligonucleotide"
uuuuagaacaccuuuuucacu

SEQ ID NO: 3006 - RNA, 19 nt, Artificial Sequence
  source: /note="Description of Artificial Sequence: Synthetic oligonucleotide"
guggaaucugccauugcga

SEQ ID NO: 3007 - RNA, 19 nt, Artificial Sequence
  source: /note="Description of Artificial Sequence: Synthetic oligonucleotide"
guggaaucugccauugcga

SEQ ID NO: 3008 - RNA, 19 nt, Artificial Sequence
  source: /note="Description of Artificial Sequence: Synthetic oligonucleotide"
uggaaucugccauugcgau

SEQ ID NO: 3009 - RNA, 19 nt, Artificial Sequence
  source: /note="Description of Artificial Sequence: Synthetic oligonucleotide"
uggaaucugccauugcgau

SEQ ID NO: 3010 - RNA, 19 nt, Artificial Sequence
  source: /note="Description of Artificial Sequence: Synthetic oligonucleotide"
ggaaucugccauugcgauu

SEQ ID NO: 3011 - RNA, 19 nt, Artificial Sequence
  source: /note="Description of Artificial Sequence: Synthetic oligonucleotide"
ggaaucugccauugcgauu

SEQ ID NO: 3012 - RNA, 19 nt, Artificial Sequence
  source: /note="Description of Artificial Sequence: Synthetic oligonucleotide"
gaaucugccauugcgauuu

SEQ ID NO: 3013 - RNA, 19 nt, Artificial Sequence
  source: /note="Description of Artificial Sequence: Synthetic oligonucleotide"
gaaucugccauugcgauuu

SEQ ID NO: 3014 - RNA, 19 nt, Artificial Sequence
  source: /note="Description of Artificial Sequence: Synthetic oligonucleotide"
aaucugccauugcgauugu

SEQ ID NO: 3015 - RNA, 19 nt, Artificial Sequence
  source: /note="Description of Artificial Sequence: Synthetic oligonucleotide"
aaucugccauugcgauugu

SEQ ID NO: 3016 - RNA, 19 nt, Artificial Sequence
  source: /note="Description of Artificial Sequence: Synthetic oligonucleotide"
aucugccauugcgauuguu

SEQ ID NO: 3017 - RNA, 19 nt, Artificial Sequence
  source: /note="Description of Artificial Sequence: Synthetic oligonucleotide"
aucugccauugcgauuguu

SEQ ID NO: 3018 - RNA, 19 nt, Artificial Sequence
  source: /note="Description of Artificial Sequence: Synthetic oligonucleotide"
ucugccauugcgauugucu

SEQ ID NO: 3019 - RNA, 19 nt, Artificial Sequence
  source: /note="Description of Artificial Sequence: Synthetic oligonucleotide"
ucugccauugcgauugucu

SEQ ID NO: 3020 - RNA, 19 nt, Artificial Sequence
  source: /note="Description of Artificial Sequence: Synthetic oligonucleotide"
cugccauugcgauugucca

SEQ ID NO: 3021 - RNA, 19 nt, Artificial Sequence
  source: /note="Description of Artificial Sequence: Synthetic oligonucleotide"
cugccauugcgauugucca

SEQ ID NO: 3022 - RNA, 19 nt, Artificial Sequence
  source: /note="Description of Artificial Sequence: Synthetic oligonucleotide"
ugccauugcgauuguccau

SEQ ID NO: 3023 - RNA, 19 nt, Artificial Sequence
  source: /note="Description of Artificial Sequence: Synthetic oligonucleotide"
ugccauugcgauuguccau

SEQ ID NO: 3024 - RNA, 19 nt, Artificial Sequence
  source: /note="Description of Artificial Sequence: Synthetic oligonucleotide"
gccauugcgauuguccaga

SEQ ID NO: 3025 - RNA, 19 nt, Artificial Sequence
  source: /note="Description of Artificial Sequence: Synthetic oligonucleotide"
ccauugcgauuguccagau

SEQ ID NO: 3026 - RNA, 19 nt, Artificial Sequence
  source: /note="Description of Artificial Sequence: Synthetic oligonucleotide"
ccauugcgauuguccagau

SEQ ID NO: 3027 - RNA, 19 nt, Artificial Sequence
  source: /note="Description of Artificial Sequence: Synthetic oligonucleotide"
ccauugcgauuguccagau

SEQ ID NO: 3028 - RNA, 19 nt, Artificial Sequence
  source: /note="Description of Artificial Sequence: Synthetic oligonucleotide"
ccauugcgauuguccagau

SEQ ID NO: 3029 - RNA, 19 nt, Artificial Sequence
  source: /note="Description of Artificial Sequence: Synthetic oligonucleotide"
cauugcgauuguccagaga

SEQ ID NO: 3030 - RNA, 19 nt, Artificial Sequence
  source: /note="Description of Artificial Sequence: Synthetic oligonucleotide"
auugcgauuguccagagau

SEQ ID NO: 3031 - RNA, 21 nt, Artificial Sequence
  source: /note="Description of Artificial Sequence: Synthetic oligonucleotide"
cauugcgauuguccagagacu

SEQ ID NO: 3032 - RNA, 19 nt, Artificial Sequence
  source: /note="Description of Artificial Sequence: Synthetic oligonucleotide"
ugcgauuguccagagacuu

SEQ ID NO: 3033 - RNA, 19 nt, Artificial Sequence
  source: /note="Description of Artificial Sequence: Synthetic oligonucleotide"
gcgauuguccagagacugu

SEQ ID NO: 3034 - RNA, 21 nt, Artificial Sequence
  source: /note="Description of Artificial Sequence: Synthetic oligonucleotide"
uugcgauuguccagagacugu

SEQ ID NO: 3035 - RNA, 19 nt, Artificial Sequence
  source: /note="Description of Artificial Sequence: Synthetic oligonucleotide"
cgauuguccagagacuggu

SEQ ID NO: 3036 - RNA, 19 nt, Artificial Sequence
  source: /note="Description of Artificial Sequence: Synthetic oligonucleotide"
cgauuguccagagacuggu

SEQ ID NO: 3037 - RNA, 19 nt, Artificial Sequence
  source: /note="Description of Artificial Sequence: Synthetic oligonucleotide"
gauuguccagagacugguu

SEQ ID NO: 3038 - RNA, 19 nt, Artificial Sequence
  source: /note="Description of Artificial Sequence: Synthetic oligonucleotide"
gauuguccagagacugguu

SEQ ID NO: 3039 - RNA, 19 nt, Artificial Sequence
  source: /note="Description of Artificial Sequence: Synthetic oligonucleotide"
auuguccagagacugguga

SEQ ID NO: 3040 - RNA, 19 nt, Artificial Sequence
  source: /note="Description of Artificial Sequence: Synthetic oligonucleotide"
auuguccagagacugguga

SEQ ID NO: 3041 - RNA, 19 nt, Artificial Sequence
  source: /note="Description of Artificial Sequence: Synthetic oligonucleotide"
uuguccagagacuggugau

SEQ ID NO: 3042 - RNA, 19 nt, Artificial Sequence
  source: /note="Description of Artificial Sequence: Synthetic oligonucleotide"
uuguccagagacuggugau

SEQ ID NO: 3043 - RNA, 19 nt, Artificial Sequence
  source: /note="Description of Artificial Sequence: Synthetic oligonucleotide"
uguccagagacuggugaca

SEQ ID NO: 3044 - RNA, 21 nt, Artificial Sequence
  source: /note="Description of Artificial Sequence: Synthetic oligonucleotide"
ugguuuuaugaaaagcuagga

SEQ ID NO: 3045 - RNA, 21 nt, Artificial Sequence
  source: /note="Description of Artificial Sequence: Synthetic oligonucleotide"
ugguuuuaugaaaagcuagga

SEQ ID NO: 3046 - RNA, 21 nt, Artificial Sequence
  source: /note="Description of Artificial Sequence: Synthetic oligonucleotide"
gguuuuaugaaaagcuaggaa

SEQ ID NO: 3047 - RNA, 21 nt, Artificial Sequence
  source: /note="Description of Artificial Sequence: Synthetic oligonucleotide"
guuuuaugaaaagcuaggaau

SEQ ID NO: 3048 - RNA, 21 nt, Artificial Sequence
  source: /note="Description of Artificial Sequence: Synthetic oligonucleotide"
guuuuaugaaaagcuaggaau

SEQ ID NO: 3049 - RNA, 21 nt, Artificial Sequence
  source: /note="Description of Artificial Sequence: Synthetic oligonucleotide"
uuuuaugaaaagcuaggaagu

SEQ ID NO: 3050 - RNA, 21 nt, Artificial Sequence
  source: /note="Description of Artificial Sequence: Synthetic oligonucleotide"
uuuaugaaaagcuaggaagca

SEQ ID NO: 3051 - RNA, 21 nt, Artificial Sequence
  source: /note="Description of Artificial Sequence: Synthetic oligonucleotide"
uuaugaaaagcuaggaagcaa

SEQ ID NO: 3052 - RNA, 21 nt, Artificial Sequence
  source: /note="Description of Artificial Sequence: Synthetic oligonucleotide"
uaugaaaagcuaggaagcaau

SEQ ID NO: 3053 - RNA, 21 nt, Artificial Sequence
  source: /note="Description of Artificial Sequence: Synthetic oligonucleotide"
augaaaagcuaggaagcaacu

SEQ ID NO: 3054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaagctaggaagcaaccu

SEQ ID NO: 3055 - RNA, 21 nt, Artificial Sequence
  source: /note="Description of Artificial Sequence: Synthetic oligonucleotide"
gaaaagcuaggaagcaaccuu

SEQ ID NO: 3056 - RNA, 21 nt, Artificial Sequence
  source: /note="Description of Artificial Sequence: Synthetic oligonucleotide"
aaaagcuaggaagcaaccuuu

SEQ ID NO: 3057 - RNA, 21 nt, Artificial Sequence
  source: /note="Description of Artificial Sequence: Synthetic oligonucleotide"
aaaagcuaggaagcaaccuuu

SEQ ID NO: 3058 - RNA, 21 nt, Artificial Sequence
  source: /note="Description of Artificial Sequence: Synthetic oligonucleotide"
aaaagcuaggaagcaaccuuu

SEQ ID NO: 3059 - RNA, 21 nt, Artificial Sequence
  source: /note="Description of Artificial Sequence: Synthetic oligonucleotide"
aaagcuaggaagcaaccuuuu

SEQ ID NO: 3060 - RNA, 21 nt, Artificial Sequence
  source: /note="Description of Artificial Sequence: Synthetic oligonucleotide"
aagcuaggaagcaaccuuucu

SEQ ID NO: 3061 - RNA, 21 nt, Artificial Sequence
  source: /note="Description of Artificial Sequence: Synthetic oligonucleotide"
agcuaggaagcaaccuuucgu

SEQ ID NO: 3062 - RNA, 19 nt, Artificial Sequence
  source: /note="Description of Artificial Sequence: Synthetic oligonucleotide"
cuaggaagcaaccuuucgu

SEQ ID NO: 3063 - RNA, 21 nt, Artificial Sequence
  source: /note="Description of Artificial Sequence: Synthetic oligonucleotide"
gcuaggaagcaaccuuucgcu

SEQ ID NO: 3064 - RNA, 19 nt, Artificial Sequence
  source: /note="Description of Artificial Sequence: Synthetic oligonucleotide"
uaggaagcaaccuuucgcu

SEQ ID NO: 3065 - RNA, 21 nt, Artificial Sequence
  source: /note="Description of Artificial Sequence: Synthetic oligonucleotide"
cuaggaagcaaccuuucgccu

SEQ ID NO: 3066 - RNA, 19 nt, Artificial Sequence
  source: /note="Description of Artificial Sequence: Synthetic oligonucleotide"
aggaagcaaccuuucgccu

SEQ ID NO: 3067 - RNA, 21 nt, Artificial Sequence
  source: /note="Description of Artificial Sequence: Synthetic oligonucleotide"
uaggaagcaaccuuucgccuu

SEQ ID NO: 3068 - RNA, 19 nt, Artificial Sequence
  source: /note="Description of Artificial Sequence: Synthetic oligonucleotide"
ggaagcaaccuuucgccuu

SEQ ID NO: 3069 - RNA, 21 nt, Artificial Sequence
  source: /note="Description of Artificial Sequence: Synthetic oligonucleotide"
aggaagcaaccuuucgccugu

SEQ ID NO: 3070 - RNA, 19 nt, Artificial Sequence
  source: /note="Description of Artificial Sequence: Synthetic oligonucleotide"
gaagcaaccuuucgccugu

SEQ ID NO: 3071 - RNA, 19 nt, Artificial Sequence
  source: /note="Description of Artificial Sequence: Synthetic oligonucleotide"
aagcaaccuuucgccuguu

SEQ ID NO: 3072 - RNA, 19 nt, Artificial Sequence
  source: /note="Description of Artificial Sequence: Synthetic oligonucleotide"
agcaaccuuucgccugugu

SEQ ID NO: 3073 - RNA, 19 nt, Artificial Sequence
  source: /note="Description of Artificial Sequence: Synthetic oligonucleotide"
gcaaccuuucgccugugca

SEQ ID NO: 3074 - RNA, 23 nt, Artificial Sequence
  source: /note="Description of Artificial Sequence: Synthetic oligonucleotide"
auaaaaccaacucagcucagagg

SEQ ID NO: 3075 - RNA, 23 nt, Artificial Sequence
  source: /note="Description of Artificial Sequence: Synthetic oligonucleotide"
auaaaaccaacucagcucagagg

SEQ ID NO: 3076 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagagg

SEQ ID NO: 3077 - RNA, 23 nt, Artificial Sequence
  source: /note="Description of Artificial Sequence: Synthetic oligonucleotide"
auaaaaccaacucagcucagacc

SEQ ID NO: 3078 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagacc

SEQ ID NO: 3079 - RNA, 21 nt, Artificial Sequence
  source: /note="Description of Artificial Sequence: Synthetic oligonucleotide"
auaaaaccaacucagcucagc

SEQ ID NO: 3080 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagc

SEQ ID NO: 3081 - RNA, 23 nt, Artificial Sequence
  source: /note="Description of Artificial Sequence: Synthetic oligonucleotide"
auaaaaccaacucagcucagagg

SEQ ID NO: 3082 - RNA, 23 nt, Artificial Sequence
  source: /note="Description of Artificial Sequence: Synthetic oligonucleotide"
auaaaaccaacucagcucagagg

SEQ ID NO: 3083 - RNA, 23 nt, Artificial Sequence
  source: /note="Description of Artificial Sequence: Synthetic oligonucleotide"
auaaaaccaacucagcucagagg

SEQ ID NO: 3084 - RNA, 23 nt, Artificial Sequence
  source: /note="Description of Artificial Sequence: Synthetic oligonucleotide"
auaaaaccaacucagcucagagg

SEQ ID NO: 3085 - RNA, 23 nt, Artificial Sequence
  source: /note="Description of Artificial Sequence: Synthetic oligonucleotide"
auaaaaccaacucagcucagagg

SEQ ID NO: 3086 - RNA, 23 nt, Artificial Sequence
  source: /note="Description of Artificial Sequence: Synthetic oligonucleotide"
auaaaaccaacucagcucagagg

SEQ ID NO: 3087 - RNA, 23 nt, Artificial Sequence
  source: /note="Description of Artificial Sequence: Synthetic oligonucleotide"
auaaaaccaacucagcucagacc

SEQ ID NO: 3088 - RNA, 23 nt, Artificial Sequence
  source: /note="Description of Artificial Sequence: Synthetic oligonucleotide"
auaaaaccaacucagcucagacc

SEQ ID NO: 3089 - RNA, 23 nt, Artificial Sequence
  source: /note="Description of Artificial Sequence: Synthetic oligonucleotide"
auaaaaccaacucagcucagacc

SEQ ID NO: 3090 - RNA, 21 nt, Artificial Sequence
  source: /note="Description of Artificial Sequence: Synthetic oligonucleotide"
auaaaaccaacucagcucagc

SEQ ID NO: 3091 - RNA, 21 nt, Artificial Sequence
  source: /note="Description of Artificial Sequence: Synthetic oligonucleotide"
auaaaaccaacucagcucagc

SEQ ID NO: 3092 - RNA, 21 nt, Artificial Sequence
  source: /note="Description of Artificial Sequence: Synthetic oligonucleotide"
auaaaaccaacucagcucagc

SEQ ID NO: 3093 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagagg

SEQ ID NO: 3094 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagagg

SEQ ID NO: 3095 - RNA, 23 nt, Artificial Sequence
  source: /note="Description of Artificial Sequence: Synthetic oligonucleotide"
aauaagacauuauccuaaugggu

SEQ ID NO: 3096 - RNA, 23 nt, Artificial Sequence
  source: /note="Description of Artificial Sequence: Synthetic oligonucleotide"
aauaagacauuauccuaaugggu

SEQ ID NO: 3097 - RNA, 23 nt, Artificial Sequence
  source: /note="Description of Artificial Sequence: Synthetic oligonucleotide"
aauaagacauuauccuaaugggu

SEQ ID NO: 3098 - RNA, 23 nt, Artificial Sequence
  source: /note="Description of Artificial Sequence: Synthetic oligonucleotide"
aauaagacauuauccuaauggcc

SEQ ID NO: 3099 - RNA, 23 nt, Artificial Sequence
  source: /note="Description of Artificial Sequence: Synthetic oligonucleotide"
aauaagacauuauccuaauggcc

SEQ ID NO: 3100 - RNA, 23 nt, Artificial Sequence
  source: /note="Description of Artificial Sequence: Synthetic oligonucleotide"
aauaagacauuauccuaaugggu

SEQ ID NO: 3101 - RNA, 23 nt, Artificial Sequence
  source: /note="Description of Artificial Sequence: Synthetic oligonucleotide"
aauaagacauuauccuaaugggu

SEQ ID NO: 3102 - RNA, 23 nt, Artificial Sequence
  source: /note="Description of Artificial Sequence: Synthetic oligonucleotide"
aauaagacauuauccuaauggcc

SEQ ID NO: 3103 - RNA, 23 nt, Artificial Sequence
  source: /note="Description of Artificial Sequence: Synthetic oligonucleotide"
aauaagacauuauccuaauggcc

SEQ ID NO: 3104 - RNA, 21 nt, Artificial Sequence
  source: /note="Description of Artificial Sequence: Synthetic oligonucleotide"
aauaagacauuauccuaaugg

SEQ ID NO: 3105 - RNA, 21 nt, Artificial Sequence
  source: /note="Description of Artificial Sequence: Synthetic oligonucleotide"
aauaagacauuauccuaaugg

SEQ ID NO: 3106 - RNA, 23 nt, Artificial Sequence
  source: /note="Description of Artificial Sequence: Synthetic oligonucleotide"
aauaagacauuauccuaaugggu

SEQ ID NO: 3107 - RNA, 23 nt, Artificial Sequence
  source: /note="Description of Artificial Sequence: Synthetic oligonucleotide"
aauaagacauuauccuaaugggu

SEQ ID NO: 3108 - RNA, 23 nt, Artificial Sequence
  source: /note="Description of Artificial Sequence: Synthetic oligonucleotide"
aauaagacauuauccuaaugggu

SEQ ID NO: 3109 - RNA, 23 nt, Artificial Sequence
  source: /note="Description of Artificial Sequence: Synthetic oligonucleotide"
acauaagacauuauccuaauggg

SEQ ID NO: 3110 - RNA, 23 nt, Artificial Sequence
  source: /note="Description of Artificial Sequence: Synthetic oligonucleotide"
acauaagacauuauccuaauggg

SEQ ID NO: 3111 - RNA, 23 nt, Artificial Sequence
  source: /note="Description of Artificial Sequence: Synthetic oligonucleotide"
acauaagacauuauccuaaugcc

SEQ ID NO: 3112 - RNA, 23 nt, Artificial Sequence
  source: /note="Description of Artificial Sequence: Synthetic oligonucleotide"
acauaagacauuauccuaauggg

SEQ ID NO: 3113 - RNA, 23 nt, Artificial Sequence
  source: /note="Description of Artificial Sequence: Synthetic oligonucleotide"
acauaagacauuauccuaaugcc

SEQ ID NO: 3114 - RNA, 21 nt, Artificial Sequence
  source: /note="Description of Artificial Sequence: Synthetic oligonucleotide"
acauaagacauuauccuaaug

SEQ ID NO: 3115 - RNA, 23 nt, Artificial Sequence
  source: /note="Description of Artificial Sequence: Synthetic oligonucleotide"
acauaagacauuauccuaauggg

SEQ ID NO: 3116 - RNA, 23 nt, Artificial Sequence
  source: /note="Description of Artificial Sequence: Synthetic oligonucleotide"
acauaagacauuauccuaauggg

SEQ ID NO: 3117 - RNA, 23 nt, Artificial Sequence
  source: /note="Description of Artificial Sequence: Synthetic oligonucleotide"
acauaagacauuauccuaauggg

SEQ ID NO: 3118 - RNA, 23 nt, Artificial Sequence
  source: /note="Description of Artificial Sequence: Synthetic oligonucleotide"
acauaagacauuauccuaauggg

SEQ ID NO: 3119 - RNA, 23 nt, Artificial Sequence
  source: /note="Description of Artificial Sequence: Synthetic oligonucleotide"
auuacauaagacauuauccuaau

SEQ ID NO: 3120 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuaau

SEQ ID NO: 3121 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuaau

SEQ ID NO: 3122 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3123 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3124 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuacc

SEQ ID NO: 3125 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuacc

SEQ ID NO: 3126 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3127 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3128 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3129 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3130 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3131 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3132 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3133 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3134 - RNA, 23 nt, Artificial Sequence
  source: /note="Description of Artificial Sequence: Synthetic oligonucleotide"
auuuucauaaaaccaacucagcu

SEQ ID NO: 3135 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3136 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3137 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3138 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3139 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3140 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3141 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3142 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3143 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3144 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucgg

SEQ ID NO: 3146 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucgg

SEQ ID NO: 3147 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3148 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3149 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3150 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3151 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3152 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucgg

SEQ ID NO: 3153 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucgg

SEQ ID NO: 3154 - RNA, 23 nt, Artificial Sequence
  source: /note="Description of Artificial Sequence: Synthetic oligonucleotide"
auuuuaguagucaagguuaucau

SEQ ID NO: 3155 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3156 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3157 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3158 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3159 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3160 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3161 - RNA, 23 nt, Artificial Sequence
  source: /note="Description of Artificial Sequence: Synthetic oligonucleotide"
auuuuaguagucaagguuaucau

SEQ ID NO: 3162 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3163 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3164 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3165 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3166 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3167 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3168 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuauc

SEQ ID NO: 3169 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuauc

SEQ ID NO: 3170 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuauc

SEQ ID NO: 3171 - RNA, 23 nt, Artificial Sequence
  source: /note="Description of Artificial Sequence: Synthetic oligonucleotide"
agugaaaaagguguucuaaaauu

SEQ ID NO: 3172 - RNA, 23 nt, Artificial Sequence
  source: /note="Description of Artificial Sequence: Synthetic oligonucleotide"
agugaaaaagguguucuaaaauu

SEQ ID NO: 3173 - RNA, 23 nt, Artificial Sequence
  source: /note="Description of Artificial Sequence: Synthetic oligonucleotide"
agugaaaaagguguucuaaaauu

SEQ ID NO: 3174 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaaggtguucuaaaauu

SEQ ID NO: 3175 - RNA, 23 nt, Artificial Sequence
  source: /note="Description of Artificial Sequence: Synthetic oligonucleotide"
agugaaaaagguguucuaaaacc

SEQ ID NO: 3176 - RNA, 23 nt, Artificial Sequence
  source: /note="Description of Artificial Sequence: Synthetic oligonucleotide"
agugaaaaagguguucuaaaacc

SEQ ID NO: 3177 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaaggtguucuaaaacc

SEQ ID NO: 3178 - RNA, 23 nt, Artificial Sequence
  source: /note="Description of Artificial Sequence: Synthetic oligonucleotide"
agugaaaaagguguucuaaaauu

SEQ ID NO: 3179 - RNA, 23 nt, Artificial Sequence
  source: /note="Description of Artificial Sequence: Synthetic oligonucleotide"
agugaaaaagguguucuaaaauu

SEQ ID NO: 3180 - RNA, 23 nt, Artificial Sequence
  source: /note="Description of Artificial Sequence: Synthetic oligonucleotide"
agugaaaaagguguucuaaaauu

SEQ ID NO: 3181 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaaggtguucuaaaauu

SEQ ID NO: 3182 - RNA, 23 nt, Artificial Sequence
  source: /note="Description of Artificial Sequence: Synthetic oligonucleotide"
agugaaaaagguguucuaaaauu

SEQ ID NO: 3183 - RNA, 23 nt, Artificial Sequence
  source: /note="Description of Artificial Sequence: Synthetic oligonucleotide"
agugaaaaagguguucuaaaauu

SEQ ID NO: 3184 - RNA, 23 nt, Artificial Sequence
  source: /note="Description of Artificial Sequence: Synthetic oligonucleotide"
agugaaaaagguguucuaaaauu

SEQ ID NO: 3185 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaaggtguucuaaaauu

SEQ ID NO: 3186 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcaatggcagauuccacag

SEQ ID NO: 3187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcaatggcagauuccacgg

SEQ ID NO: 3188 - RNA, 21 nt, Artificial Sequence
  source: /note="Description of Artificial Sequence: Synthetic oligonucleotide"
aucgcaauggcagauuccaca

SEQ ID NO: 3189 - RNA, 21 nt, Artificial Sequence
  source: /note="Description of Artificial Sequence: Synthetic oligonucleotide"
aucgcaauggcagauuccacg

SEQ ID NO: 3190 - RNA, 21 nt, Artificial Sequence
  source: /note="Description of Artificial Sequence: Synthetic oligonucleotide"
aaucgcaauggcagauuccac

SEQ ID NO: 3191 - RNA, 21 nt, Artificial Sequence
  source: /note="Description of Artificial Sequence: Synthetic oligonucleotide"
aaucgcaauggcagauuccgc

SEQ ID NO: 3192 - RNA, 21 nt, Artificial Sequence
  source: /note="Description of Artificial Sequence: Synthetic oligonucleotide"
aaaucgcaauggcagauucca

SEQ ID NO: 3193 - RNA, 21 nt, Artificial Sequence
  source: /note="Description of Artificial Sequence: Synthetic oligonucleotide"
aaaucgcaauggcagauuccg

SEQ ID NO: 3194 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaatcgcaauggcagauucc

SEQ ID NO: 3195 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaatcgcaauggcagauucc

SEQ ID NO: 3196 - RNA, 21 nt, Artificial Sequence
  source: /note="Description of Artificial Sequence: Synthetic oligonucleotide"
aacaaucgcaauggcagauuc

SEQ ID NO: 3197 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaaucgcaatggcagauuc

SEQ ID NO: 3198 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacaatcgcaauggcagauu

SEQ ID NO: 3199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacaatcgcaauggcagauu

SEQ ID NO: 3200 - RNA, 21 nt, Artificial Sequence
  source: /note="Description of Artificial Sequence: Synthetic oligonucleotide"
uggacaaucgcaauggcagau

SEQ ID NO: 3201 - RNA, 21 nt, Artificial Sequence
  source: /note="Description of Artificial Sequence: Synthetic oligonucleotide"
uggacaaucgcaauggcagau

SEQ ID NO: 3202 - RNA, 21 nt, Artificial Sequence
  source: /note="Description of Artificial Sequence: Synthetic oligonucleotide"
auggacaaucgcaauggcaga

SEQ ID NO: 3203 - RNA, 21 nt, Artificial Sequence
  source: /note="Description of Artificial Sequence: Synthetic oligonucleotide"
auggacaaucgcaauggcagg

SEQ ID NO: 3204 - RNA, 21 nt, Artificial Sequence
  source: /note="Description of Artificial Sequence: Synthetic oligonucleotide"
ucuggacaaucgcaauggcgg

SEQ ID NO: 3205 - RNA, 19 nt, Artificial Sequence
  source: /note="Description of Artificial Sequence: Synthetic oligonucleotide"
aucuggacaaucgcaaugg

SEQ ID NO: 3206 - RNA, 19 nt, Artificial Sequence
  source: /note="Description of Artificial Sequence: Synthetic oligonucleotide"
aucuggacaaucgcaaugg

SEQ ID NO: 3207 - RNA, 21 nt, Artificial Sequence
  source: /note="Description of Artificial Sequence: Synthetic oligonucleotide"
aucuggacaaucgcaauggca

SEQ ID NO: 3208 - RNA, 21 nt, Artificial Sequence
  source: /note="Description of Artificial Sequence: Synthetic oligonucleotide"
aucuggacaaucgcaauggcg

SEQ ID NO: 3209 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuctggacaaucgcaauggc

SEQ ID NO: 3210 - RNA, 21 nt, Artificial Sequence
  source: /note="Description of Artificial Sequence: Synthetic oligonucleotide"
aucucuggacaaucgcaaugg

SEQ ID NO: 3211 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguctctggacaaucgcaauggc

SEQ ID NO: 3212 - RNA, 21 nt, Artificial Sequence
  source: /note="Description of Artificial Sequence: Synthetic oligonucleotide"
aagucucuggacaaucgcagu

SEQ ID NO: 3213 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagtctcuggacaaucgcaa

SEQ ID NO: 3214 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtctcuggacaaucgcaaug

SEQ ID NO: 3215 - RNA, 21 nt, Artificial Sequence
  source: /note="Description of Artificial Sequence: Synthetic oligonucleotide"
accagucucuggacaaucgca

SEQ ID NO: 3216 - RNA, 21 nt, Artificial Sequence
  source: /note="Description of Artificial Sequence: Synthetic oligonucleotide"
accagucucuggacaaucgcg

SEQ ID NO: 3217 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccagtcucuggacaaucgc

SEQ ID NO: 3218 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccagtcucuggacaaucgc

SEQ ID NO: 3219 - RNA, 21 nt, Artificial Sequence
  source: /note="Description of Artificial Sequence: Synthetic oligonucleotide"
ucaccagucucuggacaaucg

SEQ ID NO: 3220 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccagucuctggacaaucg

SEQ ID NO: 3221 - RNA, 21 nt, Artificial Sequence
  source: /note="Description of Artificial Sequence: Synthetic oligonucleotide"
aucaccagucucuggacaauc

SEQ ID NO: 3222 - RNA, 21 nt, Artificial Sequence
  source: /note="Description of Artificial Sequence: Synthetic oligonucleotide"
aucaccagucucuggacaauc

SEQ ID NO: 3223 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaccaguctcuggacagu

SEQ ID NO: 3224 - RNA, 23 nt, Artificial Sequence
  source: /note="Description of Artificial Sequence: Synthetic oligonucleotide"
uccuagcuuuucauaaaaccaac

SEQ ID NO: 3225 - RNA, 23 nt, Artificial Sequence
  source: /note="Description of Artificial Sequence: Synthetic oligonucleotide"
uccuagcuuuucauaaaaccagc

SEQ ID NO: 3226 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucctagcuuuucauaaaaccgg

SEQ ID NO: 3227 - RNA, 23 nt, Artificial Sequence
  source: /note="Description of Artificial Sequence: Synthetic oligonucleotide"
auuccuagcuuuucauaaaacca

SEQ ID NO: 3228 - RNA, 23 nt, Artificial Sequence
  source: /note="Description of Artificial Sequence: Synthetic oligonucleotide"
auuccuagcuuuucauaaaaccg

SEQ ID NO: 3229 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucctagcuuuucauaaaacc

SEQ ID NO: 3230 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcutccuagcuuuucauaaagc

SEQ ID NO: 3231 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctuccuagcuuuucauaagg

SEQ ID NO: 3232 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugcutccuagcuuuucauagg

SEQ ID NO: 3233 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguugctuccuagcuuuucaugg

SEQ ID NO: 3234 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggutgcuucctagcuuuucaug

SEQ ID NO: 3235 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggtugcuuccuagcuuuucgu

SEQ ID NO: 3236 - RNA, 23 nt, Artificial Sequence
  source: /note="Description of Artificial Sequence: Synthetic oligonucleotide"
aaagguugcuuccuagcuuuuca

SEQ ID NO: 3237 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaggutgcuuccuagcuuuuca

SEQ ID NO: 3238 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaggutgcuuccuagcuuuucg

SEQ ID NO: 3239 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaggtugcuuccuagcuuuuc

SEQ ID NO: 3240 - RNA, 23 nt, Artificial Sequence
  source: /note="Description of Artificial Sequence: Synthetic oligonucleotide"
agaaagguugcuuccuagcuuuu

SEQ ID NO: 3241 - RNA, 23 nt, Artificial Sequence
  source: /note="Description of Artificial Sequence: Synthetic oligonucleotide"
acgaaagguugcuuccuagcuuu

SEQ ID NO: 3242 - RNA, 21 nt, Artificial Sequence
  source: /note="Description of Artificial Sequence: Synthetic oligonucleotide"
acgaaagguugcuuccuagcu

SEQ ID NO: 3243 - RNA, 23 nt, Artificial Sequence
  source: /note="Description of Artificial Sequence: Synthetic oligonucleotide"
agcgaaagguugcuuccuagcuu

SEQ ID NO: 3244 - RNA, 21 nt, Artificial Sequence
  source: /note="Description of Artificial Sequence: Synthetic oligonucleotide"
agcgaaagguugcuuccuagc

SEQ ID NO: 3245 - RNA, 23 nt, Artificial Sequence
  source: /note="Description of Artificial Sequence: Synthetic oligonucleotide"
aggcgaaagguugcuuccuagcu

SEQ ID NO: 3246 - RNA, 21 nt, Artificial Sequence
  source: /note="Description of Artificial Sequence: Synthetic oligonucleotide"
aggcgaaagguugcuuccugg

SEQ ID NO: 3247 - RNA, 23 nt, Artificial Sequence
  source: /note="Description of Artificial Sequence: Synthetic oligonucleotide"
aaggcgaaagguugcuuccuagc

SEQ ID NO: 3248 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggcgaaaggtugcuuccug

SEQ ID NO: 3249 - RNA, 23 nt, Artificial Sequence
  source: /note="Description of Artificial Sequence: Synthetic oligonucleotide"
acaggcgaaagguugcuuccuag

SEQ ID NO: 3250 - RNA, 21 nt, Artificial Sequence
  source: /note="Description of Artificial Sequence: Synthetic oligonucleotide"
acaggcgaaagguugcuuccu

SEQ ID NO: 3251 - RNA, 21 nt, Artificial Sequence
  source: /note="Description of Artificial Sequence: Synthetic oligonucleotide"
aacaggcgaaagguugcuucc

SEQ ID NO: 3252 - RNA, 21 nt, Artificial Sequence
  source: /note="Description of Artificial Sequence: Synthetic oligonucleotide"
acacaggcgaaagguugcuuc

SEQ ID NO: 3253 - RNA, 21 nt, Artificial Sequence
  source: /note="Description of Artificial Sequence: Synthetic oligonucleotide"
ugcacaggcgaaagguugcuu

SEQ ID NO: 3254 - RNA, 21 nt, Artificial Sequence
  source: /note="Description of Artificial Sequence: Synthetic oligonucleotide"
ucugagcugaguugguuuuau

SEQ ID NO: 3255 - RNA, 21 nt, Artificial Sequence
  source: /note="Description of Artificial Sequence: Synthetic oligonucleotide"
ucugagcugaguugguuuuau

SEQ ID NO: 3256 - RNA, 21 nt, Artificial Sequence
  source: /note="Description of Artificial Sequence: Synthetic oligonucleotide"
ucugagcugaguugguuuuau

SEQ ID NO: 3257 - RNA, 21 nt, Artificial Sequence
  source: /note="Description of Artificial Sequence: Synthetic oligonucleotide"
ucugagcugaguugguuuuau

SEQ ID NO: 3258 - RNA, 21 nt, Artificial Sequence
  source: /note="Description of Artificial Sequence: Synthetic oligonucleotide"
ucugagcugaguugguuuuau

SEQ ID NO: 3259 - RNA, 19 nt, Artificial Sequence
  source: /note="Description of Artificial Sequence: Synthetic oligonucleotide"
ugagcugaguugguuuuau

SEQ ID NO: 3260 - RNA, 19 nt, Artificial Sequence
  source: /note="Description of Artificial Sequence: Synthetic oligonucleotide"
ugagcugaguugguuuuau

SEQ ID NO: 3261 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3262 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3263 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3264 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3265 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3266 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3267 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3268 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3269 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3270 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ugagcugaguugguuuuau

SEQ ID NO: 3271 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ugagcugaguugguuuuau

SEQ ID NO: 3272 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ugagcugaguugguuuuau

SEQ ID NO: 3273 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguugguuuuau

SEQ ID NO: 3274 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagcugaguuggutuuau

SEQ ID NO: 3275 - RNA, 21 nt, Artificial Sequence
  source: /note="Description of Artificial Sequence: Synthetic oligonucleotide"
ccauuaggauaaugucuuauu

SEQ ID NO: 3276 - RNA, 21 nt, Artificial Sequence
  source: /note="Description of Artificial Sequence: Synthetic oligonucleotide"
ccauuaggauaaugucuuauu

SEQ ID NO: 3277 - RNA, 21 nt, Artificial Sequence
  source: /note="Description of Artificial Sequence: Synthetic oligonucleotide"
ccauuaggauaaugucuuauu

SEQ ID NO: 3278 - RNA, 21 nt, Artificial Sequence
  source: /note="Description of Artificial Sequence: Synthetic oligonucleotide"
ccauuaggauaaugucuuauu

SEQ ID NO: 3279 - RNA, 21 nt, Artificial Sequence
  source: /note="Description of Artificial Sequence: Synthetic oligonucleotide"
ccauuaggauaaugucuuauu

SEQ ID NO: 3280 - RNA, 21 nt, Artificial Sequence
  source: /note="Description of Artificial Sequence: Synthetic oligonucleotide"
ccauuaggauaaugucuuauu

SEQ ID NO: 3281 - RNA, 21 nt, Artificial Sequence
  source: /note="Description of Artificial Sequence: Synthetic oligonucleotide"
ccauuaggauaaugucuuauu

SEQ ID NO: 3282 - RNA, 21 nt, Artificial Sequence
  source: /note="Description of Artificial Sequence: Synthetic oligonucleotide"
ccauuaggauaaugucuuauu

SEQ ID NO: 3283 - RNA, 21 nt, Artificial Sequence
  source: /note="Description of Artificial Sequence: Synthetic oligonucleotide"
ccauuaggauaaugucuuauu

SEQ ID NO: 3284 - RNA, 19 nt, Artificial Sequence
  source: /note="Description of Artificial Sequence: Synthetic oligonucleotide"
auuaggauaaugucuuauu

SEQ ID NO: 3285 - RNA, 19 nt, Artificial Sequence
  source: /note="Description of Artificial Sequence: Synthetic oligonucleotide"
auuaggauaaugucuuauu

SEQ ID NO: 3286 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauuaggauaaugucuuauu

SEQ ID NO: 3287 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauuaggauaaugucuuauu

SEQ ID NO: 3288 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauuaggauaauguctuauu

SEQ ID NO: 3289 - RNA, 21 nt, Artificial Sequence
  source: /note="Description of Artificial Sequence: Synthetic oligonucleotide"
cauuaggauaaugucuuaugu

SEQ ID NO: 3290 - RNA, 21 nt, Artificial Sequence
  source: /note="Description of Artificial Sequence: Synthetic oligonucleotide"
cauuaggauaaugucuuaugu

SEQ ID NO: 3291 - RNA, 21 nt, Artificial Sequence
  source: /note="Description of Artificial Sequence: Synthetic oligonucleotide"
cauuaggauaaugucuuaugu

SEQ ID NO: 3292 - RNA, 21 nt, Artificial Sequence
  source: /note="Description of Artificial Sequence: Synthetic oligonucleotide"
cauuaggauaaugucuuaugu

SEQ ID NO: 3293 - RNA, 21 nt, Artificial Sequence
  source: /note="Description of Artificial Sequence: Synthetic oligonucleotide"
cauuaggauaaugucuuaugu

SEQ ID NO: 3294 - RNA, 19 nt, Artificial Sequence
  source: /note="Description of Artificial Sequence: Synthetic oligonucleotide"
uuaggauaaugucuuaugu

SEQ ID NO: 3295 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuaggataaugucuuaugu

SEQ ID NO: 3296 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuaggataaugucutaugu

SEQ ID NO: 3297 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuaggauaaugucuuaugu

SEQ ID NO: 3298 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuaggauaaugucutaugu

SEQ ID NO: 3299 - RNA, 21 nt, Artificial Sequence
  source: /note="Description of Artificial Sequence: Synthetic oligonucleotide"
uaggauaaugucuuauguaau

SEQ ID NO: 3300 - RNA, 21 nt, Artificial Sequence
  source: /note="Description of Artificial Sequence: Synthetic oligonucleotide"
uaggauaaugucuuauguaau

SEQ ID NO: 3301 - RNA, 21 nt, Artificial Sequence
  source: /note="Description of Artificial Sequence: Synthetic oligonucleotide"
uaggauaaugucuuauguaau

SEQ ID NO: 3302 - RNA, 21 nt, Artificial Sequence
  source: /note="Description of Artificial Sequence: Synthetic oligonucleotide"
uaggauaaugucuuauguaau

SEQ ID NO: 3303 - RNA, 21 nt, Artificial Sequence
  source: /note="Description of Artificial Sequence: Synthetic oligonucleotide"
uaggauaaugucuuauguaau

SEQ ID NO: 3304 - RNA, 21 nt, Artificial Sequence
  source: /note="Description of Artificial Sequence: Synthetic oligonucleotide"
uaggauaaugucuuauguaau

SEQ ID NO: 3305 - RNA, 21 nt, Artificial Sequence
  source: /note="Description of Artificial Sequence: Synthetic oligonucleotide"
uaggauaaugucuuauguaau

SEQ ID NO: 3306 - RNA, 21 nt, Artificial Sequence
  source: /note="Description of Artificial Sequence: Synthetic oligonucleotide"
uaggauaaugucuuauguaau

SEQ ID NO: 3307 - RNA, 21 nt, Artificial Sequence
  source: /note="Description of Artificial Sequence: Synthetic oligonucleotide"
uaggauaaugucuuauguaau

SEQ ID NO: 3308 - RNA, 21 nt, Artificial Sequence
  source: /note="Description of Artificial Sequence: Synthetic oligonucleotide"
uaggauaaugucuuauguaau

SEQ ID NO: 3309 - RNA, 21 nt, Artificial Sequence
  source: /note="Description of Artificial Sequence: Synthetic oligonucleotide"
uaggauaaugucuuauguaau

SEQ ID NO: 3310 - RNA, 21 nt, Artificial Sequence
  source: /note="Description of Artificial Sequence: Synthetic oligonucleotide"
uaggauaaugucuuauguaau

SEQ ID NO: 3311 - RNA, 21 nt, Artificial Sequence
  source: /note="Description of Artificial Sequence: Synthetic oligonucleotide"
uaggauaaugucuuauguaau

SEQ ID NO: 3312 - RNA, 21 nt, Artificial Sequence
  source: /note="Description of Artificial Sequence: Synthetic oligonucleotide"
uaggauaaugucuuauguaau

SEQ ID NO: 3313 - RNA, 21 nt, Artificial Sequence
  source: /note="Description of Artificial Sequence: Synthetic oligonucleotide"
uaggauaaugucuuauguaau

SEQ ID NO: 3314 - RNA, 21 nt, Artificial Sequence
  source: /note="Description of Artificial Sequence: Synthetic oligonucleotide"
cugaguugguuuuaugaaaau

SEQ ID NO: 3315 - RNA, 21 nt, Artificial Sequence
  source: /note="Description of Artificial Sequence: Synthetic oligonucleotide"
cugaguugguuuuaugaaaau

SEQ ID NO: 3316 - RNA, 21 nt, Artificial Sequence
  source: /note="Description of Artificial Sequence: Synthetic oligonucleotide"
cugaguugguuuuaugaaaau

SEQ ID NO: 3317 - RNA, 21 nt, Artificial Sequence
  source: /note="Description of Artificial Sequence: Synthetic oligonucleotide"
cugaguugguuuuaugaaaau

SEQ ID NO: 3318 - RNA, 21 nt, Artificial Sequence
  source: /note="Description of Artificial Sequence: Synthetic oligonucleotide"
cugaguugguuuuaugaaaau

SEQ ID NO: 3319 - RNA, 21 nt, Artificial Sequence
  source: /note="Description of Artificial Sequence: Synthetic oligonucleotide"
cugaguugguuuuaugaaaau

SEQ ID NO: 3320 - RNA, 21 nt, Artificial Sequence
  source: /note="Description of Artificial Sequence: Synthetic oligonucleotide"
cugaguugguuuuaugaaaau

SEQ ID NO: 3321 - RNA, 21 nt, Artificial Sequence
  source: /note="Description of Artificial Sequence: Synthetic oligonucleotide"
cugaguugguuuuaugaaaau

SEQ ID NO: 3322 - RNA, 21 nt, Artificial Sequence
  source: /note="Description of Artificial Sequence: Synthetic oligonucleotide"
cugaguugguuuuaugaaaau

SEQ ID NO: 3323 - RNA, 21 nt, Artificial Sequence
  source: /note="Description of Artificial Sequence: Synthetic oligonucleotide"
cugaguugguuuuaugaaaau

SEQ ID NO: 3324 - RNA, 21 nt, Artificial Sequence
  source: /note="Description of Artificial Sequence: Synthetic oligonucleotide"
cugaguugguuuuaugaaaau

SEQ ID NO: 3325 - RNA, 19 nt, Artificial Sequence
  source: /note="Description of Artificial Sequence: Synthetic oligonucleotide"
gaguugguuuuaugaaaau

SEQ ID NO: 3326 - RNA, 19 nt, Artificial Sequence
  source: /note="Description of Artificial Sequence: Synthetic oligonucleotide"
gaguugguuuuaugaaaau

SEQ ID NO: 3327 - RNA, 21 nt, Artificial Sequence
  source: /note="Description of Artificial Sequence: Synthetic oligonucleotide"
cugaguugguuuuaugaaaau

SEQ ID NO: 3328 - RNA, 21 nt, Artificial Sequence
  source: /note="Description of Artificial Sequence: Synthetic oligonucleotide"
cugaguugguuuuaugaaaau

SEQ ID NO: 3329 - RNA, 21 nt, Artificial Sequence
  source: /note="Description of Artificial Sequence: Synthetic oligonucleotide"
cugaguugguuuuaugaaaau

SEQ ID NO: 3330 - RNA, 21 nt, Artificial Sequence
  source: /note="Description of Artificial Sequence: Synthetic oligonucleotide"
cugaguugguuuuaugaaaau

SEQ ID NO: 3331 - RNA, 21 nt, Artificial Sequence
  source: /note="Description of Artificial Sequence: Synthetic oligonucleotide"
cugaguugguuuuaugaaaau

SEQ ID NO: 3332 - RNA, 19 nt, Artificial Sequence
  source: /note="Description of Artificial Sequence: Synthetic oligonucleotide"
gaguugguuuuaugaaaau

SEQ ID NO: 3333 - RNA, 19 nt, Artificial Sequence
  source: /note="Description of Artificial Sequence: Synthetic oligonucleotide"
gaguugguuuuaugaaaau

SEQ ID NO: 3334 - RNA, 21 nt, Artificial Sequence
  source: /note="Description of Artificial Sequence: Synthetic oligonucleotide"
gauaaccuugacuacuaaaau

SEQ ID NO: 3335 - RNA, 21 nt, Artificial Sequence
  source: /note="Description of Artificial Sequence: Synthetic oligonucleotide"
gauaaccuugacuacuaaaau

SEQ ID NO: 3336 - RNA, 21 nt, Artificial Sequence
  source: /note="Description of Artificial Sequence: Synthetic oligonucleotide"
gauaaccuugacuacuaaaau

SEQ ID NO: 3337 - RNA, 21 nt, Artificial Sequence
  source: /note="Description of Artificial Sequence: Synthetic oligonucleotide"
gauaaccuugacuacuaaaau

SEQ ID NO: 3338 - RNA, 21 nt, Artificial Sequence
  source: /note="Description of Artificial Sequence: Synthetic oligonucleotide"
gauaaccuugacuacuaaaau

SEQ ID NO: 3339 - RNA, 21 nt, Artificial Sequence
  source: /note="Description of Artificial Sequence: Synthetic oligonucleotide"
gauaaccuugacuacuaaaau

SEQ ID NO: 3340 - RNA, 21 nt, Artificial Sequence
  source: /note="Description of Artificial Sequence: Synthetic oligonucleotide"
gauaaccuugacuacuaaaau

SEQ ID NO: 3341 - RNA, 21 nt, Artificial Sequence
  source: /note="Description of Artificial Sequence: Synthetic oligonucleotide"
gauaaccuugacuacuaaaau

SEQ ID NO: 3342 - RNA, 21 nt, Artificial Sequence
  source: /note="Description of Artificial Sequence: Synthetic oligonucleotide"
gauaaccuugacuacuaaaau

SEQ ID NO: 3343 - RNA, 21 nt, Artificial Sequence
  source: /note="Description of Artificial Sequence: Synthetic oligonucleotide"
gauaaccuugacuacuaaaau

SEQ ID NO: 3344 - RNA, 21 nt, Artificial Sequence
  source: /note="Description of Artificial Sequence: Synthetic oligonucleotide"
gauaaccuugacuacuaaaau

SEQ ID NO: 3345 - RNA, 21 nt, Artificial Sequence
  source: /note="Description of Artificial Sequence: Synthetic oligonucleotide"
gauaaccuugacuacuaaaau

SEQ ID NO: 3346 - RNA, 21 nt, Artificial Sequence
  source: /note="Description of Artificial Sequence: Synthetic oligonucleotide"
gauaaccuugacuacuaaaau

SEQ ID NO: 3347 - RNA, 21 nt, Artificial Sequence
  source: /note="Description of Artificial Sequence: Synthetic oligonucleotide"
gauaaccuugacuacuaaaau

SEQ ID NO: 3348 - RNA, 19 nt, Artificial Sequence
  source: /note="Description of Artificial Sequence: Synthetic oligonucleotide"
uaaccuugacuacuaaaau

SEQ ID NO: 3349 - RNA, 19 nt, Artificial Sequence
  source: /note="Description of Artificial Sequence: Synthetic oligonucleotide"
uaaccuugacuacuaaaau

SEQ ID NO: 3350 - RNA, 19 nt, Artificial Sequence
  source: /note="Description of Artificial Sequence: Synthetic oligonucleotide"
uaaccuugacuacuaaaau

SEQ ID NO: 3351 - RNA, 21 nt, Artificial Sequence
  source: /note="Description of Artificial Sequence: Synthetic oligonucleotide"
uuuuagaacaccuuuuucacu

SEQ ID NO: 3352 - RNA, 21 nt, Artificial Sequence
  source: /note="Description of Artificial Sequence: Synthetic oligonucleotide"
uuuuagaacaccuuuuucacu

SEQ ID NO: 3353 - RNA, 21 nt, Artificial Sequence
  source: /note="Description of Artificial Sequence: Synthetic oligonucleotide"
uuuuagaacaccuuuuucacu

SEQ ID NO: 3354 - RNA, 21 nt, Artificial Sequence
  source: /note="Description of Artificial Sequence: Synthetic oligonucleotide"
uuuuagaacaccuuuuucacu

SEQ ID NO: 3355 - RNA, 21 nt, Artificial Sequence
  source: /note="Description of Artificial Sequence: Synthetic oligonucleotide"
uuuuagaacaccuuuuucacu

SEQ ID NO: 3356 - RNA, 21 nt, Artificial Sequence
  source: /note="Description of Artificial Sequence: Synthetic oligonucleotide"
uuuuagaacaccuuuuucacu

SEQ ID NO: 3357 - RNA, 21 nt, Artificial Sequence
  source: /note="Description of Artificial Sequence: Synthetic oligonucleotide"
uuuuagaacaccuuuuucacu

SEQ ID NO: 3358 - RNA, 21 nt, Artificial Sequence
  source: /note="Description of Artificial Sequence: Synthetic oligonucleotide"
uuuuagaacaccuuuuucacu

SEQ ID NO: 3359 - RNA, 21 nt, Artificial Sequence
  source: /note="Description of Artificial Sequence: Synthetic oligonucleotide"
uuuuagaacaccuuuuucacu

SEQ ID NO: 3360 - RNA, 21 nt, Artificial Sequence
  source: /note="Description of Artificial Sequence: Synthetic oligonucleotide"
uuuuagaacaccuuuuucacu

SEQ ID NO: 3361 - RNA, 21 nt, Artificial Sequence
  source: /note="Description of Artificial Sequence: Synthetic oligonucleotide"
uuuuagaacaccuuuuucacu

SEQ ID NO: 3362 - RNA, 21 nt, Artificial Sequence
  source: /note="Description of Artificial Sequence: Synthetic oligonucleotide"
uuuuagaacaccuuuuucacu

SEQ ID NO: 3363 - RNA, 21 nt, Artificial Sequence
  source: /note="Description of Artificial Sequence: Synthetic oligonucleotide"
uuuuagaacaccuuuuucacu

SEQ ID NO: 3364 - RNA, 21 nt, Artificial Sequence
  source: /note="Description of Artificial Sequence: Synthetic oligonucleotide"
uuuuagaacaccuuuuucacu

SEQ ID NO: 3365 - RNA, 21 nt, Artificial Sequence
  source: /note="Description of Artificial Sequence: Synthetic oligonucleotide"
uuuuagaacaccuuuuucacu

SEQ ID NO: 3366 - RNA, 19 nt, Artificial Sequence
  source: /note="Description of Artificial Sequence: Synthetic oligonucleotide"
guggaaucugccauugcga

SEQ ID NO: 3367 - RNA, 19 nt, Artificial Sequence
  source: /note="Description of Artificial Sequence: Synthetic oligonucleotide"
guggaaucugccauugcga

SEQ ID NO: 3368 - RNA, 19 nt, Artificial Sequence
  source: /note="Description of Artificial Sequence: Synthetic oligonucleotide"
uggaaucugccauugcgau

SEQ ID NO: 3369 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
uggaaucugccauugcgau

SEQ ID NO: 3370 - RNA, 19 nt, Artificial Sequence
  source: /note="Description of Artificial Sequence: Synthetic oligonucleotide"
ggaaucugccauugcgauu

SEQ ID NO: 3371 - RNA, 19 nt, Artificial Sequence
  source: /note="Description of Artificial Sequence: Synthetic oligonucleotide"
ggaaucugccauugcgauu

SEQ ID NO: 3372 - RNA, 19 nt, Artificial Sequence
  source: /note="Description of Artificial Sequence: Synthetic oligonucleotide"
gaaucugccauugcgauuu

SEQ ID NO: 3373 - RNA, 19 nt, Artificial Sequence
  source: /note="Description of Artificial Sequence: Synthetic oligonucleotide"
gaaucugccauugcgauuu

SEQ ID NO: 3374 - RNA, 19 nt, Artificial Sequence
  source: /note="Description of Artificial Sequence: Synthetic oligonucleotide"
aaucugccauugcgauugu

SEQ ID NO: 3375 - RNA, 19 nt, Artificial Sequence
  source: /note="Description of Artificial Sequence: Synthetic oligonucleotide"
aaucugccauugcgauugu

SEQ ID NO: 3376 - RNA, 19 nt, Artificial Sequence
  source: /note="Description of Artificial Sequence: Synthetic oligonucleotide"
aucugccauugcgauuguu

SEQ ID NO: 3377 - RNA, 19 nt, Artificial Sequence
  source: /note="Description of Artificial Sequence: Synthetic oligonucleotide"
aucugccauugcgauuguu

SEQ ID NO: 3378 - RNA, 19 nt, Artificial Sequence
  source: /note="Description of Artificial Sequence: Synthetic oligonucleotide"
ucugccauugcgauugucu

SEQ ID NO: 3379 - RNA, 19 nt, Artificial Sequence
  source: /note="Description of Artificial Sequence: Synthetic oligonucleotide"
ucugccauugcgauugucu

SEQ ID NO: 3380 - RNA, 19 nt, Artificial Sequence
  source: /note="Description of Artificial Sequence: Synthetic oligonucleotide"
cugccauugcgauugucca

SEQ ID NO: 3381 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
cugccauugcgauugucca

SEQ ID NO: 3382 - RNA, 19 nt, Artificial Sequence
  source: /note="Description of Artificial Sequence: Synthetic oligonucleotide"
ugccauugcgauuguccau

SEQ ID NO: 3383 - RNA, 19 nt, Artificial Sequence
  source: /note="Description of Artificial Sequence: Synthetic oligonucleotide"
ugccauugcgauuguccau

SEQ ID NO: 3384 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
gccauugcgauuguccaga

SEQ ID NO: 3385 - RNA, 19 nt, Artificial Sequence
  source: /note="Description of Artificial Sequence: Synthetic oligonucleotide"
ccauugcgauuguccagau

SEQ ID NO: 3386 - RNA, 19 nt, Artificial Sequence
  source: /note="Description of Artificial Sequence: Synthetic oligonucleotide"
ccauugcgauuguccagau

SEQ ID NO: 3387 - RNA, 19 nt, Artificial Sequence
  source: /note="Description of Artificial Sequence: Synthetic oligonucleotide"
ccauugcgauuguccagau

SEQ ID NO: 3388 - RNA, 19 nt, Artificial Sequence
  source: /note="Description of Artificial Sequence: Synthetic oligonucleotide"
ccauugcgauuguccagau

SEQ ID NO: 3389 - RNA, 19 nt, Artificial Sequence
  source: /note="Description of Artificial Sequence: Synthetic oligonucleotide"
cauugcgauuguccagaga

SEQ ID NO: 3390 - RNA, 19 nt, Artificial Sequence
  source: /note="Description of Artificial Sequence: Synthetic oligonucleotide"
auugcgauuguccagagau

SEQ ID NO: 3391 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauugcgauuguccagagacu

SEQ ID NO: 3392 - RNA, 19 nt, Artificial Sequence
  source: /note="Description of Artificial Sequence: Synthetic oligonucleotide"
ugcgauuguccagagacuu

SEQ ID NO: 3393 - RNA, 19 nt, Artificial Sequence
  source: /note="Description of Artificial Sequence: Synthetic oligonucleotide"
gcgauuguccagagacugu

SEQ ID NO: 3394 - RNA, 21 nt, Artificial Sequence
  source: /note="Description of Artificial Sequence: Synthetic oligonucleotide"
uugcgauuguccagagacugu

SEQ ID NO: 3395 - RNA, 19 nt, Artificial Sequence
  source: /note="Description of Artificial Sequence: Synthetic oligonucleotide"
cgauuguccagagacuggu

SEQ ID NO: 3396 - RNA, 19 nt, Artificial Sequence
  source: /note="Description of Artificial Sequence: Synthetic oligonucleotide"
cgauuguccagagacuggu

SEQ ID NO: 3397 - RNA, 19 nt, Artificial Sequence
  source: /note="Description of Artificial Sequence: Synthetic oligonucleotide"
gauuguccagagacugguu

SEQ ID NO: 3398 - RNA, 19 nt, Artificial Sequence
  source: /note="Description of Artificial Sequence: Synthetic oligonucleotide"
gauuguccagagacugguu

SEQ ID NO: 3399 - RNA, 19 nt, Artificial Sequence
  source: /note="Description of Artificial Sequence: Synthetic oligonucleotide"
auuguccagagacugguga

SEQ ID NO: 3400 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
auuguccagagacugguga

SEQ ID NO: 3401 - RNA, 19 nt, Artificial Sequence
  source: /note="Description of Artificial Sequence: Synthetic oligonucleotide"
uuguccagagacuggugau

SEQ ID NO: 3402 - RNA, 19 nt, Artificial Sequence
  source: /note="Description of Artificial Sequence: Synthetic oligonucleotide"
uuguccagagacuggugau

SEQ ID NO: 3403 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
uguccagagacuggugaca

SEQ ID NO: 3404 - RNA, 21 nt, Artificial Sequence
  source: /note="Description of Artificial Sequence: Synthetic oligonucleotide"
ugguuuuaugaaaagcuagga

SEQ ID NO: 3405 - RNA, 21 nt, Artificial Sequence
  source: /note="Description of Artificial Sequence: Synthetic oligonucleotide"
ugguuuuaugaaaagcuagga

SEQ ID NO: 3406 - RNA, 21 nt, Artificial Sequence
  source: /note="Description of Artificial Sequence: Synthetic oligonucleotide"
gguuuuaugaaaagcuaggaa

SEQ ID NO: 3407 - RNA, 21 nt, Artificial Sequence
  source: /note="Description of Artificial Sequence: Synthetic oligonucleotide"
guuuuaugaaaagcuaggaau

SEQ ID NO: 3408 - RNA, 21 nt, Artificial Sequence
  source: /note="Description of Artificial Sequence: Synthetic oligonucleotide"
guuuuaugaaaagcuaggaau

SEQ ID NO: 3409 - RNA, 21 nt, Artificial Sequence
  source: /note="Description of Artificial Sequence: Synthetic oligonucleotide"
uuuuaugaaaagcuaggaagu

SEQ ID NO: 3410 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaugaaaagcuaggaagca

SEQ ID NO: 3411 - RNA, 21 nt, Artificial Sequence
  source: /note="Description of Artificial Sequence: Synthetic oligonucleotide"
uuaugaaaagcuaggaagcaa

SEQ ID NO: 3412 - RNA, 21 nt, Artificial Sequence
  source: /note="Description of Artificial Sequence: Synthetic oligonucleotide"
uaugaaaagcuaggaagcaau

SEQ ID NO: 3413 - RNA, 21 nt, Artificial Sequence
  source: /note="Description of Artificial Sequence: Synthetic oligonucleotide"
augaaaagcuaggaagcaacu

SEQ ID NO: 3414 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaagctaggaagcaaccu

SEQ ID NO: 3415 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaaagcuaggaagcaaccuu

SEQ ID NO: 3416 - RNA, 21 nt, Artificial Sequence
  source: /note="Description of Artificial Sequence: Synthetic oligonucleotide"
aaaagcuaggaagcaaccuuu

SEQ ID NO: 3417 - RNA, 21 nt, Artificial Sequence
  source: /note="Description of Artificial Sequence: Synthetic oligonucleotide"
aaaagcuaggaagcaaccuuu

SEQ ID NO: 3418 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagcuaggaagcaaccuuu

SEQ ID NO: 3419 - RNA, 21 nt, Artificial Sequence
  source: /note="Description of Artificial Sequence: Synthetic oligonucleotide"
aaagcuaggaagcaaccuuuu

SEQ ID NO: 3420 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcuaggaagcaaccuuucu

SEQ ID NO: 3421 - RNA, 21 nt, Artificial Sequence
  source: /note="Description of Artificial Sequence: Synthetic oligonucleotide"
agcuaggaagcaaccuuucgu

SEQ ID NO: 3422 - RNA, 19 nt, Artificial Sequence
  source: /note="Description of Artificial Sequence: Synthetic oligonucleotide"
cuaggaagcaaccuuucgu

SEQ ID NO: 3423 - RNA, 21 nt, Artificial Sequence
  source: /note="Description of Artificial Sequence: Synthetic oligonucleotide"
gcuaggaagcaaccuuucgcu

SEQ ID NO: 3424 - RNA, 19 nt, Artificial Sequence
  source: /note="Description of Artificial Sequence: Synthetic oligonucleotide"
uaggaagcaaccuuucgcu

SEQ ID NO: 3425 - RNA, 21 nt, Artificial Sequence
  source: /note="Description of Artificial Sequence: Synthetic oligonucleotide"
cuaggaagcaaccuuucgccu

SEQ ID NO: 3426 - RNA, 19 nt, Artificial Sequence
  source: /note="Description of Artificial Sequence: Synthetic oligonucleotide"
aggaagcaaccuuucgccu

SEQ ID NO: 3427 - RNA, 21 nt, Artificial Sequence
  source: /note="Description of Artificial Sequence: Synthetic oligonucleotide"
uaggaagcaaccuuucgccuu

SEQ ID NO: 3428 - RNA, 19 nt, Artificial Sequence
  source: /note="Description of Artificial Sequence: Synthetic oligonucleotide"
ggaagcaaccuuucgccuu

SEQ ID NO: 3429 - RNA, 21 nt, Artificial Sequence
  source: /note="Description of Artificial Sequence: Synthetic oligonucleotide"
aggaagcaaccuuucgccugu

SEQ ID NO: 3430 - RNA, 19 nt, Artificial Sequence
  source: /note="Description of Artificial Sequence: Synthetic oligonucleotide"
gaagcaaccuuucgccugu

SEQ ID NO: 3431 - RNA, 19 nt, Artificial Sequence
  source: /note="Description of Artificial Sequence: Synthetic oligonucleotide"
aagcaaccuuucgccuguu

SEQ ID NO: 3432 - RNA, 19 nt, Artificial Sequence
  source: /note="Description of Artificial Sequence: Synthetic oligonucleotide"
agcaaccuuucgccugugu

SEQ ID NO: 3433 - RNA, 19 nt, Artificial Sequence
  source: /note="Description of Artificial Sequence: Synthetic oligonucleotide"
gcaaccuuucgccugugca

SEQ ID NO: 3434 - RNA, 23 nt, Artificial Sequence
  source: /note="Description of Artificial Sequence: Synthetic oligonucleotide"
auaaaaccaacucagcucagagg

SEQ ID NO: 3435 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagagg

SEQ ID NO: 3436 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagagg

SEQ ID NO: 3437 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagacc

SEQ ID NO: 3438 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagacc

SEQ ID NO: 3439 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagc

SEQ ID NO: 3440 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagc

SEQ ID NO: 3441 - RNA, 23 nt, Artificial Sequence
  source: /note="Description of Artificial Sequence: Synthetic oligonucleotide"
auaaaaccaacucagcucagagg

SEQ ID NO: 3442 - RNA, 23 nt, Artificial Sequence
  source: /note="Description of Artificial Sequence: Synthetic oligonucleotide"
auaaaaccaacucagcucagagg

SEQ ID NO: 3443 - RNA, 23 nt, Artificial Sequence
  source: /note="Description of Artificial Sequence: Synthetic oligonucleotide"
auaaaaccaacucagcucagagg

SEQ ID NO: 3444 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagagg

SEQ ID NO: 3445 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagagg

SEQ ID NO: 3446 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagagg

SEQ ID NO: 3447 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagacc

SEQ ID NO: 3448 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagacc

SEQ ID NO: 3449 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagacc

SEQ ID NO: 3450 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagc

SEQ ID NO: 3451 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagc

SEQ ID NO: 3452 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaaaccaacucagcucagc

SEQ ID NO: 3453 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagagg

SEQ ID NO: 3454 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ataaaaccaactcagcucagagg

SEQ ID NO: 3455 - RNA, 23 nt, Artificial Sequence
  source: /note="Description of Artificial Sequence: Synthetic oligonucleotide"
aauaagacauuauccuaaugggu

SEQ ID NO: 3456 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaaugggu

SEQ ID NO: 3457 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaaugggu

SEQ ID NO: 3458 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaauggcc

SEQ ID NO: 3459 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaauggcc

SEQ ID NO: 3460 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaaugggu

SEQ ID NO: 3461 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaaugggu

SEQ ID NO: 3462 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaauggcc

SEQ ID NO: 3463 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaauggcc

SEQ ID NO: 3464 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaaugg

SEQ ID NO: 3465 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaaugg

SEQ ID NO: 3466 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaaugggu

SEQ ID NO: 3467 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaaugggu

SEQ ID NO: 3468 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaagacauuauccuaaugggu

SEQ ID NO: 3469 - RNA, 23 nt, Artificial Sequence
  source: /note="Description of Artificial Sequence: Synthetic oligonucleotide"
acauaagacauuauccuaauggg

SEQ ID NO: 3470 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaagacauuauccuaauggg

SEQ ID NO: 3471 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaagacauuauccuaaugcc

SEQ ID NO: 3472 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaagacauuauccuaauggg

SEQ ID NO: 3473 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaagacauuauccuaaugcc

SEQ ID NO: 3474 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauaagacauuauccuaaug

SEQ ID NO: 3475 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaagacauuauccuaauggg

SEQ ID NO: 3476 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaagacauuauccuaauggg

SEQ ID NO: 3477 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaagacauuauccuaauggg

SEQ ID NO: 3478 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauaagacauuauccuaauggg

SEQ ID NO: 3479 - RNA, 23 nt, Artificial Sequence
  source: /note="Description of Artificial Sequence: Synthetic oligonucleotide"
auuacauaagacauuauccuaau

SEQ ID NO: 3480 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuaau

SEQ ID NO: 3481 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuaau

SEQ ID NO: 3482 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3483 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3484 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuacc

SEQ ID NO: 3485 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuacc

SEQ ID NO: 3486 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3487 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3488 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3489 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3490 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3491 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3492 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3493 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuacataagacauuauccuagu

SEQ ID NO: 3494 - RNA, 23 nt, Artificial Sequence
  source: /note="Description of Artificial Sequence: Synthetic oligonucleotide"
auuuucauaaaaccaacucagcu

SEQ ID NO: 3495 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3496 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3497 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3498 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3499 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3500 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3501 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3502 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3503 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3504 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3505 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucgg

SEQ ID NO: 3506 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucgg

SEQ ID NO: 3507 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3508 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3509 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucagcu

SEQ ID NO: 3510 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3511 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucaguc

SEQ ID NO: 3512 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucgg

SEQ ID NO: 3513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutcauaaaaccaacucgg

SEQ ID NO: 3514 - RNA, 23 nt, Artificial Sequence
  source: /note="Description of Artificial Sequence: Synthetic oligonucleotide"
auuuuaguagucaagguuaucau

SEQ ID NO: 3515 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3516 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3517 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3518 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3519 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3520 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3521 - RNA, 23 nt, Artificial Sequence
  source: /note="Description of Artificial Sequence: Synthetic oligonucleotide"
auuuuaguagucaagguuaucau

SEQ ID NO: 3522 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3523 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3524 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucau

SEQ ID NO: 3525 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3526 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3527 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuaucgu

SEQ ID NO: 3528 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuauc

SEQ ID NO: 3529 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuauc

SEQ ID NO: 3530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuutaguagucaagguuauc

SEQ ID NO: 3531 - RNA, 23 nt, Artificial Sequence
  source: /note="Description of Artificial Sequence: Synthetic oligonucleotide"
agugaaaaagguguucuaaaauu

SEQ ID NO: 3532 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaagguguucuaaaauu

SEQ ID NO: 3533 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaagguguucuaaaauu

SEQ ID NO: 3534 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaaggtguucuaaaauu

SEQ ID NO: 3535 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaagguguucuaaaacc

SEQ ID NO: 3536 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaagguguucuaaaacc

SEQ ID NO: 3537 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaaggtguucuaaaacc

SEQ ID NO: 3538 - RNA, 23 nt, Artificial Sequence
  source: /note="Description of Artificial Sequence: Synthetic oligonucleotide"
agugaaaaagguguucuaaaauu

SEQ ID NO: 3539 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaagguguucuaaaauu

SEQ ID NO: 3540 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaagguguucuaaaauu

SEQ ID NO: 3541 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaaggtguucuaaaauu

SEQ ID NO: 3542 - RNA, 23 nt, Artificial Sequence
  source: /note="Description of Artificial Sequence: Synthetic oligonucleotide"
agugaaaaagguguucuaaaauu

SEQ ID NO: 3543 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaagguguucuaaaauu

SEQ ID NO: 3544 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaagguguucuaaaauu

SEQ ID NO: 3545 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugaaaaaggtguucuaaaauu

SEQ ID NO: 3546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcaatggcagauuccacag

SEQ ID NO: 3547 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcaatggcagauuccacgg

SEQ ID NO: 3548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgcaauggcagauuccaca

SEQ ID NO: 3549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgcaauggcagauuccacg

SEQ ID NO: 3550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucgcaauggcagauuccac

SEQ ID NO: 3551 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucgcaauggcagauuccgc

SEQ ID NO: 3552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaucgcaauggcagauucca

SEQ ID NO: 3553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaucgcaauggcagauuccg

SEQ ID NO: 3554 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaatcgcaauggcagauucc

SEQ ID NO: 3555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaatcgcaauggcagauucc

SEQ ID NO: 3556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaaucgcaauggcagauuc

SEQ ID NO: 3557 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaaucgcaatggcagauuc

SEQ ID NO: 3558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacaatcgcaauggcagauu

SEQ ID NO: 3559 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacaatcgcaauggcagauu

SEQ ID NO: 3560 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacaaucgcaauggcagau

SEQ ID NO: 3561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacaaucgcaauggcagau

SEQ ID NO: 3562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggacaaucgcaauggcaga

SEQ ID NO: 3563 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggacaaucgcaauggcagg

SEQ ID NO: 3564 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuggacaaucgcaauggcgg

SEQ ID NO: 3565 - RNA, 19 nt, Artificial Sequence
  source: /note="Description of Artificial Sequence: Synthetic oligonucleotide"
aucuggacaaucgcaaugg

SEQ ID NO: 3566 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
aucuggacaaucgcaaugg

SEQ ID NO: 3567 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuggacaaucgcaauggca

SEQ ID NO: 3568 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuggacaaucgcaauggcg

SEQ ID NO: 3569 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuctggacaaucgcaauggc

SEQ ID NO: 3570 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucucuggacaaucgcaaugg

SEQ ID NO: 3571 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguctctggacaaucgcaauggc

SEQ ID NO: 3572 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucucuggacaaucgcagu

SEQ ID NO: 3573 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagtctcuggacaaucgcaa

SEQ ID NO: 3574 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtctcuggacaaucgcaaug

SEQ ID NO: 3575 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagucucuggacaaucgca

SEQ ID NO: 3576 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagucucuggacaaucgcg

SEQ ID NO: 3577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccagtcucuggacaaucgc

SEQ ID NO: 3578 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccagtcucuggacaaucgc

SEQ ID NO: 3579 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccagucucuggacaaucg

SEQ ID NO: 3580 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccagucuctggacaaucg

SEQ ID NO: 3581 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaccagucucuggacaauc

SEQ ID NO: 3582 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaccagucucuggacaauc

SEQ ID NO: 3583 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaccaguctcuggacagu

SEQ ID NO: 3584 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuagcuuuucauaaaaccaac

SEQ ID NO: 3585 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuagcuuuucauaaaaccagc

SEQ ID NO: 3586 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucctagcuuuucauaaaaccgg

SEQ ID NO: 3587 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuccuagcuuuucauaaaacca

SEQ ID NO: 3588 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuccuagcuuuucauaaaaccg

SEQ ID NO: 3589 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucctagcuuuucauaaaacc

SEQ ID NO: 3590 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcutccuagcuuuucauaaagc

SEQ ID NO: 3591 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctuccuagcuuuucauaagg

SEQ ID NO: 3592 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugcutccuagcuuuucauagg

SEQ ID NO: 3593 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguugctuccuagcuuuucaugg

SEQ ID NO: 3594 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggutgcuucctagcuuuucaug

SEQ ID NO: 3595 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggtugcuuccuagcuuuucgu

SEQ ID NO: 3596 - RNA, 23 nt, Artificial Sequence
  source: /note="Description of Artificial Sequence: Synthetic oligonucleotide"
aaagguugcuuccuagcuuuuca

SEQ ID NO: 3597 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaggutgcuuccuagcuuuuca

SEQ ID NO: 3598 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaggutgcuuccuagcuuuucg

SEQ ID NO: 3599 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaggtugcuuccuagcuuuuc

SEQ ID NO: 3600 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaagguugcuuccuagcuuuu

SEQ ID NO: 3601 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgaaagguugcuuccuagcuuu

SEQ ID NO: 3602 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaaagguugcuuccuagcu

SEQ ID NO: 3603 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcgaaagguugcuuccuagcuu

SEQ ID NO: 3604 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgaaagguugcuuccuagc

SEQ ID NO: 3605 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggcgaaagguugcuuccuagcu

SEQ ID NO: 3606 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcgaaagguugcuuccugg

SEQ ID NO: 3607 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggcgaaagguugcuuccuagc

SEQ ID NO: 3608 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggcgaaaggtugcuuccug

SEQ ID NO: 3609 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaggcgaaagguugcuuccuag

SEQ ID NO: 3610 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaggcgaaagguugcuuccu

SEQ ID NO: 3611 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaggcgaaagguugcuucc

SEQ ID NO: 3612 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacaggcgaaagguugcuuc

SEQ ID NO: 3613 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcacaggcgaaagguugcuu

SEQ ID NO: 3614 - RNA, 23 nt, Artificial Sequence
  source: /note="Description of Artificial Sequence: Synthetic oligonucleotide"
ccucugagcugaguugguuuuau

SEQ ID NO: 3615 - RNA, 23 nt, Artificial Sequence
  source: /note="Description of Artificial Sequence: Synthetic oligonucleotide"
ccucugagcugaguugguuuuau

SEQ ID NO: 3616 - RNA, 23 nt, Artificial Sequence
  source: /note="Description of Artificial Sequence: Synthetic oligonucleotide"
ccucugagcugaguugguuuuau

SEQ ID NO: 3617 - RNA, 23 nt, Artificial Sequence
  source: /note="Description of Artificial Sequence: Synthetic oligonucleotide"
ccucugagcugaguugguuuuau

SEQ ID NO: 3618 - RNA, 23 nt, Artificial Sequence
  source: /note="Description of Artificial Sequence: Synthetic oligonucleotide"
ccucugagcugaguugguuuuau

SEQ ID NO: 3619 - RNA, 21 nt, Artificial Sequence
  source: /note="Description of Artificial Sequence: Synthetic oligonucleotide"
ucugagcugaguugguuuuau

SEQ ID NO: 3620 - RNA, 21 nt, Artificial Sequence
  source: /note="Description of Artificial Sequence: Synthetic oligonucleotide"
ucugagcugaguugguuuuau

SEQ ID NO: 3621 - RNA, 23 nt, Artificial Sequence
  source: /note="Description of Artificial Sequence: Synthetic oligonucleotide"
ccucugagcugaguugguuuuau

SEQ ID NO: 3622 - RNA, 23 nt, Artificial Sequence
  source: /note="Description of Artificial Sequence: Synthetic oligonucleotide"
ccucugagcugaguugguuuuau

SEQ ID NO: 3623 - RNA, 23 nt, Artificial Sequence
  source: /note="Description of Artificial Sequence: Synthetic oligonucleotide"
ccucugagcugaguugguuuuau

SEQ ID NO: 3624 - RNA, 23 nt, Artificial Sequence
  source: /note="Description of Artificial Sequence: Synthetic oligonucleotide"
ccucugagcugaguugguuuuau

SEQ ID NO: 3625 - RNA, 23 nt, Artificial Sequence
  source: /note="Description of Artificial Sequence: Synthetic oligonucleotide"
ccucugagcugaguugguuuuau

SEQ ID NO: 3626 - RNA, 23 nt, Artificial Sequence
  source: /note="Description of Artificial Sequence: Synthetic oligonucleotide"
ccucugagcugaguugguuuuau

SEQ ID NO: 3627 - RNA, 23 nt, Artificial Sequence
  source: /note="Description of Artificial Sequence: Synthetic oligonucleotide"
ccucugagcugaguugguuuuau

SEQ ID NO: 3628 - RNA, 23 nt, Artificial Sequence
  source: /note="Description of Artificial Sequence: Synthetic oligonucleotide"
ccucugagcugaguugguuuuau

SEQ ID NO: 3629 - RNA, 23 nt, Artificial Sequence
  source: /note="Description of Artificial Sequence: Synthetic oligonucleotide"
ccucugagcugaguugguuuuau

SEQ ID NO: 3630 - RNA, 21 nt, Artificial Sequence
  source: /note="Description of Artificial Sequence: Synthetic oligonucleotide"
ucugagcugaguugguuuuau

SEQ ID NO: 3631 - RNA, 21 nt, Artificial Sequence
  source: /note="Description of Artificial Sequence: Synthetic oligonucleotide"
ucugagcugaguugguuuuau

SEQ ID NO: 3632 - RNA, 21 nt, Artificial Sequence
  source: /note="Description of Artificial Sequence: Synthetic oligonucleotide"
ucugagcugaguugguuuuau

SEQ ID NO: 3633 - RNA, 23 nt, Artificial Sequence
  source: /note="Description of Artificial Sequence: Synthetic oligonucleotide"
ccucugagcugaguugguuuuau

SEQ ID NO: 3634 - RNA, 23 nt, Artificial Sequence
  source: /note="Description of Artificial Sequence: Synthetic oligonucleotide"
ccucugagcugaguugguuuuau

SEQ ID NO: 3635 - RNA, 23 nt, Artificial Sequence
  source: /note="Description of Artificial Sequence: Synthetic oligonucleotide"
acccauuaggauaaugucuuaug

SEQ ID NO: 3636 - RNA, 23 nt, Artificial Sequence
  source: /note="Description of Artificial Sequence: Synthetic oligonucleotide"
acccauuaggauaaugucuuaug

SEQ ID NO: 3637 - RNA, 23 nt, Artificial Sequence
  source: /note="Description of Artificial Sequence: Synthetic oligonucleotide"
acccauuaggauaaugucuuaug

SEQ ID NO: 3638 - RNA, 23 nt, Artificial Sequence
  source: /note="Description of Artificial Sequence: Synthetic oligonucleotide"
acccauuaggauaaugucuuaug

SEQ ID NO: 3639 - RNA, 23 nt, Artificial Sequence
  source: /note="Description of Artificial Sequence: Synthetic oligonucleotide"
acccauuaggauaaugucuuaug

SEQ ID NO: 3640 - RNA, 23 nt, Artificial Sequence
  source: /note="Description of Artificial Sequence: Synthetic oligonucleotide"
acccauuaggauaaugucuuaug

SEQ ID NO: 3641 - RNA, 23 nt, Artificial Sequence
  source: /note="Description of Artificial Sequence: Synthetic oligonucleotide"
acccauuaggauaaugucuuaug

SEQ ID NO: 3642 - RNA, 23 nt, Artificial Sequence
  source: /note="Description of Artificial Sequence: Synthetic oligonucleotide"
acccauuaggauaaugucuuaug

SEQ ID NO: 3643 - RNA, 23 nt, Artificial Sequence
  source: /note="Description of Artificial Sequence: Synthetic oligonucleotide"
acccauuaggauaaugucuuaug

SEQ ID NO: 3644 - RNA, 21 nt, Artificial Sequence
  source: /note="Description of Artificial Sequence: Synthetic oligonucleotide"
ccauuaggauaaugucuuaug

SEQ ID NO: 3645 - RNA, 21 nt, Artificial Sequence
  source: /note="Description of Artificial Sequence: Synthetic oligonucleotide"
ccauuaggauaaugucuuaug

SEQ ID NO: 3646 - RNA, 23 nt, Artificial Sequence
  source: /note="Description of Artificial Sequence: Synthetic oligonucleotide"
acccauuaggauaaugucuuaug

SEQ ID NO: 3647 - RNA, 23 nt, Artificial Sequence
  source: /note="Description of Artificial Sequence: Synthetic oligonucleotide"
acccauuaggauaaugucuuaug

SEQ ID NO: 3648 - RNA, 23 nt, Artificial Sequence
  source: /note="Description of Artificial Sequence: Synthetic oligonucleotide"
acccauuaggauaaugucuuaug

SEQ ID NO: 3649 - RNA, 23 nt, Artificial Sequence
  source: /note="Description of Artificial Sequence: Synthetic oligonucleotide"
cccauuaggauaaugucuuaugu

SEQ ID NO: 3650 - RNA, 23 nt, Artificial Sequence
  source: /note="Description of Artificial Sequence: Synthetic oligonucleotide"
cccauuaggauaaugucuuaugu

SEQ ID NO: 3651 - RNA, 23 nt, Artificial Sequence
  source: /note="Description of Artificial Sequence: Synthetic oligonucleotide"
cccauuaggauaaugucuuaugu

SEQ ID NO: 3652 - RNA, 23 nt, Artificial Sequence
  source: /note="Description of Artificial Sequence: Synthetic oligonucleotide"
cccauuaggauaaugucuuaugu

SEQ ID NO: 3653 - RNA, 23 nt, Artificial Sequence
  source: /note="Description of Artificial Sequence: Synthetic oligonucleotide"
cccauuaggauaaugucuuaugu

SEQ ID NO: 3654 - RNA, 21 nt, Artificial Sequence
  source: /note="Description of Artificial Sequence: Synthetic oligonucleotide"
cauuaggauaaugucuuaugu

SEQ ID NO: 3655 - RNA, 23 nt, Artificial Sequence
  source: /note="Description of Artificial Sequence: Synthetic oligonucleotide"
cccauuaggauaaugucuuaugu

SEQ ID NO: 3656 - RNA, 23 nt, Artificial Sequence
  source: /note="Description of Artificial Sequence: Synthetic oligonucleotide"
cccauuaggauaaugucuuaugu

SEQ ID NO: 3657 - RNA, 23 nt, Artificial Sequence
  source: /note="Description of Artificial Sequence: Synthetic oligonucleotide"
cccauuaggauaaugucuuaugu

SEQ ID NO: 3658 - RNA, 23 nt, Artificial Sequence
  source: /note="Description of Artificial Sequence: Synthetic oligonucleotide"
cccauuaggauaaugucuuaugu

SEQ ID NO: 3659 - RNA, 23 nt, Artificial Sequence
  source: /note="Description of Artificial Sequence: Synthetic oligonucleotide"
auuaggauaaugucuuauguaau

SEQ ID NO: 3660 - RNA, 23 nt, Artificial Sequence
  source: /note="Description of Artificial Sequence: Synthetic oligonucleotide"
auuaggauaaugucuuauguaau

SEQ ID NO: 3661 - RNA, 23 nt, Artificial Sequence
  source: /note="Description of Artificial Sequence: Synthetic oligonucleotide"
auuaggauaaugucuuauguaau

SEQ ID NO: 3662 - RNA, 23 nt, Artificial Sequence
  source: /note="Description of Artificial Sequence: Synthetic oligonucleotide"
auuaggauaaugucuuauguaau

SEQ ID NO: 3663 - RNA, 23 nt, Artificial Sequence
  source: /note="Description of Artificial Sequence: Synthetic oligonucleotide"
auuaggauaaugucuuauguaau

SEQ ID NO: 3664 - RNA, 23 nt, Artificial Sequence
  source: /note="Description of Artificial Sequence: Synthetic oligonucleotide"
auuaggauaaugucuuauguaau

SEQ ID NO: 3665 - RNA, 23 nt, Artificial Sequence
  source: /note="Description of Artificial Sequence: Synthetic oligonucleotide"
auuaggauaaugucuuauguaau

SEQ ID NO: 3666 - RNA, 23 nt, Artificial Sequence
  source: /note="Description of Artificial Sequence: Synthetic oligonucleotide"
auuaggauaaugucuuauguaau

SEQ ID NO: 3667 - RNA, 23 nt, Artificial Sequence
  source: /note="Description of Artificial Sequence: Synthetic oligonucleotide"
auuaggauaaugucuuauguaau

SEQ ID NO: 3668 - RNA, 23 nt, Artificial Sequence
  source: /note="Description of Artificial Sequence: Synthetic oligonucleotide"
auuaggauaaugucuuauguaau

SEQ ID NO: 3669 - RNA, 23 nt, Artificial Sequence
  source: /note="Description of Artificial Sequence: Synthetic oligonucleotide"
auuaggauaaugucuuauguaau

SEQ ID NO: 3670 - RNA, 23 nt, Artificial Sequence
  source: /note="Description of Artificial Sequence: Synthetic oligonucleotide"
auuaggauaaugucuuauguaau

SEQ ID NO: 3671 - RNA, 23 nt, Artificial Sequence
  source: /note="Description of Artificial Sequence: Synthetic oligonucleotide"
auuaggauaaugucuuauguaau

SEQ ID NO: 3672 - RNA, 23 nt, Artificial Sequence
  source: /note="Description of Artificial Sequence: Synthetic oligonucleotide"
auuaggauaaugucuuauguaau

SEQ ID NO: 3673 - RNA, 23 nt, Artificial Sequence
  source: /note="Description of Artificial Sequence: Synthetic oligonucleotide"
auuaggauaaugucuuauguaau

SEQ ID NO: 3674 - RNA, 23 nt, Artificial Sequence
  source: /note="Description of Artificial Sequence: Synthetic oligonucleotide"
agcugaguugguuuuaugaaaag

SEQ ID NO: 3675 - RNA, 23 nt, Artificial Sequence
  source: /note="Description of Artificial Sequence: Synthetic oligonucleotide"
agcugaguugguuuuaugaaaag

SEQ ID NO: 3676 - RNA, 23 nt, Artificial Sequence
  source: /note="Description of Artificial Sequence: Synthetic oligonucleotide"
agcugaguugguuuuaugaaaag

SEQ ID NO: 3677 - RNA, 23 nt, Artificial Sequence
  source: /note="Description of Artificial Sequence: Synthetic oligonucleotide"
agcugaguugguuuuaugaaaag

SEQ ID NO: 3678 - RNA, 23 nt, Artificial Sequence
  source: /note="Description of Artificial Sequence: Synthetic oligonucleotide"
agcugaguugguuuuaugaaaag

SEQ ID NO: 3679 - RNA, 23 nt, Artificial Sequence
  source: /note="Description of Artificial Sequence: Synthetic oligonucleotide"
agcugaguugguuuuaugaaaag

SEQ ID NO: 3680 - RNA, 23 nt, Artificial Sequence
  source: /note="Description of Artificial Sequence: Synthetic oligonucleotide"
agcugaguugguuuuaugaaaag

SEQ ID NO: 3681 - RNA, 23 nt, Artificial Sequence
  source: /note="Description of Artificial Sequence: Synthetic oligonucleotide"
agcugaguugguuuuaugaaaag

SEQ ID NO: 3682 - RNA, 23 nt, Artificial Sequence
  source: /note="Description of Artificial Sequence: Synthetic oligonucleotide"
agcugaguugguuuuaugaaaag

SEQ ID NO: 3683 - RNA, 23 nt, Artificial Sequence
  source: /note="Description of Artificial Sequence: Synthetic oligonucleotide"
agcugaguugguuuuaugaaaag

SEQ ID NO: 3684 - RNA, 23 nt, Artificial Sequence
  source: /note="Description of Artificial Sequence: Synthetic oligonucleotide"
agcugaguugguuuuaugaaaag

SEQ ID NO: 3685 - RNA, 21 nt, Artificial Sequence
  source: /note="Description of Artificial Sequence: Synthetic oligonucleotide"
cugaguugguuuuaugaaaag

SEQ ID NO: 3686 - RNA, 21 nt, Artificial Sequence
  source: /note="Description of Artificial Sequence: Synthetic oligonucleotide"
cugaguugguuuuaugaaaag

SEQ ID NO: 3687 - RNA, 23 nt, Artificial Sequence
  source: /note="Description of Artificial Sequence: Synthetic oligonucleotide"
agcugaguugguuuuaugaaaag

SEQ ID NO: 3688 - RNA, 23 nt, Artificial Sequence
  source: /note="Description of Artificial Sequence: Synthetic oligonucleotide"
agcugaguugguuuuaugaaaag

SEQ ID NO: 3689 - RNA, 23 nt, Artificial Sequence
  source: /note="Description of Artificial Sequence: Synthetic oligonucleotide"
agcugaguugguuuuaugaaaag

SEQ ID NO: 3690 - RNA, 23 nt, Artificial Sequence
  source: /note="Description of Artificial Sequence: Synthetic oligonucleotide"
agcugaguugguuuuaugaaaag

SEQ ID NO: 3691 - RNA, 23 nt, Artificial Sequence
  source: /note="Description of Artificial Sequence: Synthetic oligonucleotide"
agcugaguugguuuuaugaaaag

SEQ ID NO: 3692 - RNA, 21 nt, Artificial Sequence
  source: /note="Description of Artificial Sequence: Synthetic oligonucleotide"
cugaguugguuuuaugaaaag

SEQ ID NO: 3693 - RNA, 21 nt, Artificial Sequence
  source: /note="Description of Artificial Sequence: Synthetic oligonucleotide"
cugaguugguuuuaugaaaag

SEQ ID NO: 3694 - RNA, 23 nt, Artificial Sequence
  source: /note="Description of Artificial Sequence: Synthetic oligonucleotide"
augauaaccuugacuacuaaaaa

SEQ ID NO: 3695 - RNA, 23 nt, Artificial Sequence
  source: /note="Description of Artificial Sequence: Synthetic oligonucleotide"
augauaaccuugacuacuaaaaa

SEQ ID NO: 3696 - RNA, 23 nt, Artificial Sequence
  source: /note="Description of Artificial Sequence: Synthetic oligonucleotide"
augauaaccuugacuacuaaaaa

SEQ ID NO: 3697 - RNA, 23 nt, Artificial Sequence
  source: /note="Description of Artificial Sequence: Synthetic oligonucleotide"
augauaaccuugacuacuaaaaa

SEQ ID NO: 3698 - RNA, 23 nt, Artificial Sequence
  source: /note="Description of Artificial Sequence: Synthetic oligonucleotide"
augauaaccuugacuacuaaaaa

SEQ ID NO: 3699 - RNA, 23 nt, Artificial Sequence
  source: /note="Description of Artificial Sequence: Synthetic oligonucleotide"
augauaaccuugacuacuaaaaa

SEQ ID NO: 3700 - RNA, 23 nt, Artificial Sequence
  source: /note="Description of Artificial Sequence: Synthetic oligonucleotide"
augauaaccuugacuacuaaaaa

SEQ ID NO: 3701 - RNA, 23 nt, Artificial Sequence
  source: /note="Description of Artificial Sequence: Synthetic oligonucleotide"
augauaaccuugacuacuaaaaa

SEQ ID NO: 3702 - RNA, 23 nt, Artificial Sequence
  source: /note="Description of Artificial Sequence: Synthetic oligonucleotide"
augauaaccuugacuacuaaaaa

SEQ ID NO: 3703 - RNA, 23 nt, Artificial Sequence
  source: /note="Description of Artificial Sequence: Synthetic oligonucleotide"
augauaaccuugacuacuaaaaa

SEQ ID NO: 3704 - RNA, 23 nt, Artificial Sequence
  source: /note="Description of Artificial Sequence: Synthetic oligonucleotide"
augauaaccuugacuacuaaaaa

SEQ ID NO: 3705 - RNA, 23 nt, Artificial Sequence
  source: /note="Description of Artificial Sequence: Synthetic oligonucleotide"
augauaaccuugacuacuaaaaa

SEQ ID NO: 3706 - RNA, 23 nt, Artificial Sequence
  source: /note="Description of Artificial Sequence: Synthetic oligonucleotide"
augauaaccuugacuacuaaaaa

SEQ ID NO: 3707 - RNA, 23 nt, Artificial Sequence
  source: /note="Description of Artificial Sequence: Synthetic oligonucleotide"
augauaaccuugacuacuaaaaa

SEQ ID NO: 3708 - RNA, 21 nt, Artificial Sequence
  source: /note="Description of Artificial Sequence: Synthetic oligonucleotide"
gauaaccuugacuacuaaaaa

SEQ ID NO: 3709 - RNA, 21 nt, Artificial Sequence
  source: /note="Description of Artificial Sequence: Synthetic oligonucleotide"
gauaaccuugacuacuaaaaa

SEQ ID NO: 3710 - RNA, 21 nt, Artificial Sequence
  source: /note="Description of Artificial Sequence: Synthetic oligonucleotide"
gauaaccuugacuacuaaaaa

SEQ ID NO: 3711 - RNA, 23 nt, Artificial Sequence
  source: /note="Description of Artificial Sequence: Synthetic oligonucleotide"
aauuuuagaacaccuuuuucacc

SEQ ID NO: 3712 - RNA, 23 nt, Artificial Sequence
  source: /note="Description of Artificial Sequence: Synthetic oligonucleotide"
aauuuuagaacaccuuuuucacc

SEQ ID NO: 3713 - RNA, 23 nt, Artificial Sequence
  source: /note="Description of Artificial Sequence: Synthetic oligonucleotide"
aauuuuagaacaccuuuuucacc

SEQ ID NO: 3714 - RNA, 23 nt, Artificial Sequence
  source: /note="Description of Artificial Sequence: Synthetic oligonucleotide"
aauuuuagaacaccuuuuucacc

SEQ ID NO: 3715 - RNA, 23 nt, Artificial Sequence
  source: /note="Description of Artificial Sequence: Synthetic oligonucleotide"
aauuuuagaacaccuuuuucacc

SEQ ID NO: 3716 - RNA, 23 nt, Artificial Sequence
  source: /note="Description of Artificial Sequence: Synthetic oligonucleotide"
aauuuuagaacaccuuuuucacc

SEQ ID NO: 3717 - RNA, 23 nt, Artificial Sequence
  source: /note="Description of Artificial Sequence: Synthetic oligonucleotide"
aauuuuagaacaccuuuuucacc

SEQ ID NO: 3718 - RNA, 23 nt, Artificial Sequence
  source: /note="Description of Artificial Sequence: Synthetic oligonucleotide"
aauuuuagaacaccuuuuucacc

SEQ ID NO: 3719 - RNA, 23 nt, Artificial Sequence
  source: /note="Description of Artificial Sequence: Synthetic oligonucleotide"
aauuuuagaacaccuuuuucacc

SEQ ID NO: 3720 - RNA, 23 nt, Artificial Sequence
  source: /note="Description of Artificial Sequence: Synthetic oligonucleotide"
aauuuuagaacaccuuuuucacc

SEQ ID NO: 3721 - RNA, 23 nt, Artificial Sequence
  source: /note="Description of Artificial Sequence: Synthetic oligonucleotide"
aauuuuagaacaccuuuuucacc

SEQ ID NO: 3722 - RNA, 23 nt, Artificial Sequence
  source: /note="Description of Artificial Sequence: Synthetic oligonucleotide"
aauuuuagaacaccuuuuucacc

SEQ ID NO: 3723 - RNA, 23 nt, Artificial Sequence
  source: /note="Description of Artificial Sequence: Synthetic oligonucleotide"
aauuuuagaacaccuuuuucacc

SEQ ID NO: 3724 - RNA, 23 nt, Artificial Sequence
  source: /note="Description of Artificial Sequence: Synthetic oligonucleotide"
aauuuuagaacaccuuuuucacc

SEQ ID NO: 3725 - RNA, 23 nt, Artificial Sequence
  source: /note="Description of Artificial Sequence: Synthetic oligonucleotide"
aauuuuagaacaccuuuuucacc

SEQ ID NO: 3726 - RNA, 21 nt, Artificial Sequence
  source: /note="Description of Artificial Sequence: Synthetic oligonucleotide"
cuguggaaucugccauugcga

SEQ ID NO: 3727 - RNA, 21 nt, Artificial Sequence
  source: /note="Description of Artificial Sequence: Synthetic oligonucleotide"
cuguggaaucugccauugcga

SEQ ID NO: 3728 - RNA, 21 nt, Artificial Sequence
  source: /note="Description of Artificial Sequence: Synthetic oligonucleotide"
uguggaaucugccauugcgau

SEQ ID NO: 3729 - RNA, 21 nt, Artificial Sequence
  source: /note="Description of Artificial Sequence: Synthetic oligonucleotide"
uguggaaucugccauugcgau

SEQ ID NO: 3730 - RNA, 21 nt, Artificial Sequence
  source: /note="Description of Artificial Sequence: Synthetic oligonucleotide"
guggaaucugccauugcgauu

SEQ ID NO: 3731 - RNA, 21 nt, Artificial Sequence
  source: /note="Description of Artificial Sequence: Synthetic oligonucleotide"
guggaaucugccauugcgauu

SEQ ID NO: 3732 - RNA, 21 nt, Artificial Sequence
  source: /note="Description of Artificial Sequence: Synthetic oligonucleotide"
uggaaucugccauugcgauug

SEQ ID NO: 3733 - RNA, 21 nt, Artificial Sequence
  source: /note="Description of Artificial Sequence: Synthetic oligonucleotide"
uggaaucugccauugcgauug

SEQ ID NO: 3734 - RNA, 21 nt, Artificial Sequence
  source: /note="Description of Artificial Sequence: Synthetic oligonucleotide"
ggaaucugccauugcgauugu

SEQ ID NO: 3735 - RNA, 21 nt, Artificial Sequence
  source: /note="Description of Artificial Sequence: Synthetic oligonucleotide"
ggaaucugccauugcgauugu

SEQ ID NO: 3736 - RNA, 21 nt, Artificial Sequence
  source: /note="Description of Artificial Sequence: Synthetic oligonucleotide"
gaaucugccauugcgauuguc

SEQ ID NO: 3737 - RNA, 21 nt, Artificial Sequence
  source: /note="Description of Artificial Sequence: Synthetic oligonucleotide"
gaaucugccauugcgauuguc

SEQ ID NO: 3738 - RNA, 21 nt, Artificial Sequence
  source: /note="Description of Artificial Sequence: Synthetic oligonucleotide"
aaucugccauugcgauugucc

SEQ ID NO: 3739 - RNA, 21 nt, Artificial Sequence
  source: /note="Description of Artificial Sequence: Synthetic oligonucleotide"
aaucugccauugcgauugucc

SEQ ID NO: 3740 - RNA, 21 nt, Artificial Sequence
  source: /note="Description of Artificial Sequence: Synthetic oligonucleotide"
aucugccauugcgauugucca

SEQ ID NO: 3741 - RNA, 21 nt, Artificial Sequence
  source: /note="Description of Artificial Sequence: Synthetic oligonucleotide"
aucugccauugcgauugucca

SEQ ID NO: 3742 - RNA, 21 nt, Artificial Sequence
  source: /note="Description of Artificial Sequence: Synthetic oligonucleotide"
ucugccauugcgauuguccag

SEQ ID NO: 3743 - RNA, 21 nt, Artificial Sequence
  source: /note="Description of Artificial Sequence: Synthetic oligonucleotide"
ucugccauugcgauuguccag

SEQ ID NO: 3744 - RNA, 21 nt, Artificial Sequence
  source: /note="Description of Artificial Sequence: Synthetic oligonucleotide"
cugccauugcgauuguccaga

SEQ ID NO: 3745 - RNA, 19 nt, Artificial Sequence
  source: /note="Description of Artificial Sequence: Synthetic oligonucleotide"
ccauugcgauuguccagag

SEQ ID NO: 3746 - RNA, 19 nt, Artificial Sequence
  source: /note="Description of Artificial Sequence: Synthetic oligonucleotide"
ccauugcgauuguccagag

SEQ ID NO: 3747 - RNA, 21 nt, Artificial Sequence
  source: /note="Description of Artificial Sequence: Synthetic oligonucleotide"
ugccauugcgauuguccagag

SEQ ID NO: 3748 - RNA, 21 nt, Artificial Sequence
  source: /note="Description of Artificial Sequence: Synthetic oligonucleotide"
ugccauugcgauuguccagag

SEQ ID NO: 3749 - RNA, 21 nt, Artificial Sequence
  source: /note="Description of Artificial Sequence: Synthetic oligonucleotide"
gccauugcgauuguccagaga

SEQ ID NO: 3750 - RNA, 21 nt, Artificial Sequence
  source: /note="Description of Artificial Sequence: Synthetic oligonucleotide"
ccauugcgauuguccagagac

SEQ ID NO: 3751 - RNA, 23 nt, Artificial Sequence
  source: /note="Description of Artificial Sequence: Synthetic oligonucleotide"
gccauugcgauuguccagagacu

SEQ ID NO: 3752 - RNA, 21 nt, Artificial Sequence
  source: /note="Description of Artificial Sequence: Synthetic oligonucleotide"
auugcgauuguccagagacug

SEQ ID NO: 3753 - RNA, 21 nt, Artificial Sequence
  source: /note="Description of Artificial Sequence: Synthetic oligonucleotide"
uugcgauuguccagagacugg

SEQ ID NO: 3754 - RNA, 23 nt, Artificial Sequence
  source: /note="Description of Artificial Sequence: Synthetic oligonucleotide"
cauugcgauuguccagagacugg

SEQ ID NO: 3755 - RNA, 21 nt, Artificial Sequence
  source: /note="Description of Artificial Sequence: Synthetic oligonucleotide"
ugcgauuguccagagacuggu

SEQ ID NO: 3756 - RNA, 21 nt, Artificial Sequence
  source: /note="Description of Artificial Sequence: Synthetic oligonucleotide"
ugcgauuguccagagacuggu

SEQ ID NO: 3757 - RNA, 21 nt, Artificial Sequence
  source: /note="Description of Artificial Sequence: Synthetic oligonucleotide"
gcgauuguccagagacuggug

SEQ ID NO: 3758 - RNA, 21 nt, Artificial Sequence
  source: /note="Description of Artificial Sequence: Synthetic oligonucleotide"
gcgauuguccagagacuggug

SEQ ID NO: 3759 - RNA, 21 nt, Artificial Sequence
  source: /note="Description of Artificial Sequence: Synthetic oligonucleotide"
cgauuguccagagacugguga

SEQ ID NO: 3760 - RNA, 21 nt, Artificial Sequence
  source: /note="Description of Artificial Sequence: Synthetic oligonucleotide"
cgauuguccagagacugguga

SEQ ID NO: 3761 - RNA, 21 nt, Artificial Sequence
  source: /note="Description of Artificial Sequence: Synthetic oligonucleotide"
gauuguccagagacuggugac

SEQ ID NO: 3762 - RNA, 21 nt, Artificial Sequence
  source: /note="Description of Artificial Sequence: Synthetic oligonucleotide"
gauuguccagagacuggugac

SEQ ID NO: 3763 - RNA, 21 nt, Artificial Sequence
  source: /note="Description of Artificial Sequence: Synthetic oligonucleotide"
auuguccagagacuggugaca

SEQ ID NO: 3764 - RNA, 23 nt, Artificial Sequence
  source: /note="Description of Artificial Sequence: Synthetic oligonucleotide"
guugguuuuaugaaaagcuagga

SEQ ID NO: 3765 - RNA, 23 nt, Artificial Sequence
  source: /note="Description of Artificial Sequence: Synthetic oligonucleotide"
guugguuuuaugaaaagcuagga

SEQ ID NO: 3766 - RNA, 23 nt, Artificial Sequence
  source: /note="Description of Artificial Sequence: Synthetic oligonucleotide"
uugguuuuaugaaaagcuaggaa

SEQ ID NO: 3767 - RNA, 23 nt, Artificial Sequence
  source: /note="Description of Artificial Sequence: Synthetic oligonucleotide"
ugguuuuaugaaaagcuaggaag

SEQ ID NO: 3768 - RNA, 23 nt, Artificial Sequence
  source: /note="Description of Artificial Sequence: Synthetic oligonucleotide"
ugguuuuaugaaaagcuaggaag

SEQ ID NO: 3769 - RNA, 23 nt, Artificial Sequence
  source: /note="Description of Artificial Sequence: Synthetic oligonucleotide"
gguuuuaugaaaagcuaggaagc

SEQ ID NO: 3770 - RNA, 23 nt, Artificial Sequence
  source: /note="Description of Artificial Sequence: Synthetic oligonucleotide"
guuuuaugaaaagcuaggaagca

SEQ ID NO: 3771 - RNA, 23 nt, Artificial Sequence
  source: /note="Description of Artificial Sequence: Synthetic oligonucleotide"
uuuuaugaaaagcuaggaagcaa

SEQ ID NO: 3772 - RNA, 23 nt, Artificial Sequence
  source: /note="Description of Artificial Sequence: Synthetic oligonucleotide"
uuuaugaaaagcuaggaagcaac

SEQ ID NO: 3773 - RNA, 23 nt, Artificial Sequence
  source: /note="Description of Artificial Sequence: Synthetic oligonucleotide"
uuaugaaaagcuaggaagcaacc

SEQ ID NO: 3774 - RNA, 23 nt, Artificial Sequence
  source: /note="Description of Artificial Sequence: Synthetic oligonucleotide"
uaugaaaagcuaggaagcaaccu

SEQ ID NO: 3775 - RNA, 23 nt, Artificial Sequence
  source: /note="Description of Artificial Sequence: Synthetic oligonucleotide"
augaaaagcuaggaagcaaccuu

SEQ ID NO: 3776 - RNA, 23 nt, Artificial Sequence
  source: /note="Description of Artificial Sequence: Synthetic oligonucleotide"
ugaaaagcuaggaagcaaccuuu

SEQ ID NO: 3777 - RNA, 23 nt, Artificial Sequence
  source: /note="Description of Artificial Sequence: Synthetic oligonucleotide"
ugaaaagcuaggaagcaaccuuu

SEQ ID NO: 3778 - RNA, 23 nt, Artificial Sequence
  source: /note="Description of Artificial Sequence: Synthetic oligonucleotide"
ugaaaagcuaggaagcaaccuuu

SEQ ID NO: 3779 - RNA, 23 nt, Artificial Sequence
  source: /note="Description of Artificial Sequence: Synthetic oligonucleotide"
gaaaagcuaggaagcaaccuuuc

SEQ ID NO: 3780 - RNA, 23 nt, Artificial Sequence
  source: /note="Description of Artificial Sequence: Synthetic oligonucleotide"
aaaagcuaggaagcaaccuuucg

SEQ ID NO: 3781 - RNA, 23 nt, Artificial Sequence
  source: /note="Description of Artificial Sequence: Synthetic oligonucleotide"
aaagcuaggaagcaaccuuucgc

SEQ ID NO: 3782 - RNA, 21 nt, Artificial Sequence
  source: /note="Description of Artificial Sequence: Synthetic oligonucleotide"
agcuaggaagcaaccuuucgc

SEQ ID NO: 3783 - RNA, 23 nt, Artificial Sequence
  source: /note="Description of Artificial Sequence: Synthetic oligonucleotide"
aagcuaggaagcaaccuuucgcc

SEQ ID NO: 3784 - RNA, 21 nt, Artificial Sequence
  source: /note="Description of Artificial Sequence: Synthetic oligonucleotide"
gcuaggaagcaaccuuucgcc

SEQ ID NO: 3785 - RNA, 23 nt, Artificial Sequence
  source: /note="Description of Artificial Sequence: Synthetic oligonucleotide"
agcuaggaagcaaccuuucgccu

SEQ ID NO: 3786 - RNA, 21 nt, Artificial Sequence
  source: /note="Description of Artificial Sequence: Synthetic oligonucleotide"
cuaggaagcaaccuuucgccu

SEQ ID NO: 3787 - RNA, 23 nt, Artificial Sequence
  source: /note="Description of Artificial Sequence: Synthetic oligonucleotide"
gcuaggaagcaaccuuucgccug

SEQ ID NO: 3788 - RNA, 21 nt, Artificial Sequence
  source: /note="Description of Artificial Sequence: Synthetic oligonucleotide"
uaggaagcaaccuuucgccug

SEQ ID NO: 3789 - RNA, 23 nt, Artificial Sequence
  source: /note="Description of Artificial Sequence: Synthetic oligonucleotide"
cuaggaagcaaccuuucgccugu

SEQ ID NO: 3790 - RNA, 21 nt, Artificial Sequence
  source: /note="Description of Artificial Sequence: Synthetic oligonucleotide"
aggaagcaaccuuucgccugu

SEQ ID NO: 3791 - RNA, 21 nt, Artificial Sequence
  source: /note="Description of Artificial Sequence: Synthetic oligonucleotide"
ggaagcaaccuuucgccugug

SEQ ID NO: 3792 - RNA, 21 nt, Artificial Sequence
  source: /note="Description of Artificial Sequence: Synthetic oligonucleotide"
gaagcaaccuuucgccugugc

SEQ ID NO: 3793 - RNA, 21 nt, Artificial Sequence
  source: /note="Description of Artificial Sequence: Synthetic oligonucleotide"
aagcaaccuuucgccugugca

We claim:

1. A double stranded ribonucleic acid (dsRNA) agent for inhibiting expression of Patatin-Like Phospholipase Domain Containing 3 (PNPLA3) in a cell, wherein the dsRNA agent comprises a sense strand and an antisense strand forming a double stranded region, wherein the sense strand comprises at least 15 contiguous nucleotides differing by no more than 3 nucleotides from the nucleotide sequence of nucleotides 1214-1234 of SEQ ID NO:1, and the antisense strand comprises at least 15 contiguous nucleotides from the nucleotide sequence of nucleotides 1572-1592 of SEQ ID NO:2, wherein all of the nucleotides of the sense strand and all of the nucleotides of the antisense strand comprise a modification selected from the group consisting of a 2'-O-methyl modification and a 2'-fluoro modification, wherein both the sense strand and the antisense strand independently comprise at least one phosphorothioate or methylphosphonate internucleotide linkage, and wherein at least one strand is conjugated to a ligand.

2. The dsRNA agent of claim 1, wherein the sense strand comprises 2-6 2'-fluoro modified nucleotides.

3. The dsRNA agent of claim 2, wherein the sense strand comprises 4 2'-fluoro modified nucleotides.

4. The dsRNA agent of claim 1, wherein the antisense strand comprises 2-8 2'-fluoro modified nucleotides.

5. The dsRNA agent of claim 4, wherein the antisense strand comprises 6 2'-fluoro modified nucleotides.

6. The dsRNA agent of claim 1, wherein the sense strand comprises 4 2'-fluoro modified nucleotides at nucleotides 7 and 9-11, counting from the 5'-end, and the antisense strand comprises 6 2'-fluoro modified nucleotides at nucleotides 2, 6, 8, 9, 14 and 16, counting from the 5'-end.

7. The dsRNA agent of claim 1, wherein the sense strand comprises two phosphorothioate or methylphosphonate internucleotide linkages at the 5'-terminus.

8. The dsRNA agent of claim 1, wherein the antisense strand comprises two phosphorothioate or methylphosphonate internucleotide linkages at both the 5'- and the 3'-terminus.

9. The dsRNA agent of claim 1, wherein the sense strand comprises two phosphorothioate or methylphosphonate internucleotide linkages at the 5'-terminus and the antisense strand comprises two phosphorothioate or methylphosphonate internucleotide linkages at both the 5'- and the 3'-terminus.

10. The dsRNA agent of claim 1, wherein the ligand is conjugated to the 3'-end of the sense strand.

11. The dsRNA agent of claim 1, wherein the ligand is an N-acetylgalactosamine (GalNAc) derivative.

12. The dsRNA agent of claim 11, wherein the ligand is one or more GalNAc derivatives attached through a monovalent, bivalent, or trivalent branched linker.

13. The dsRNA agent of claim 12, wherein the ligand is

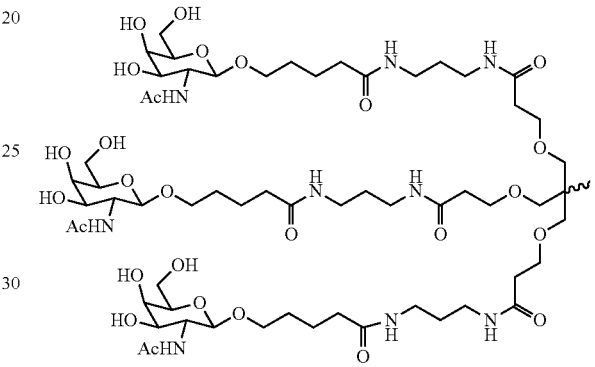

14. The dsRNA agent of claim 13, wherein the dsRNA agent is conjugated to the ligand as shown in the following schematic

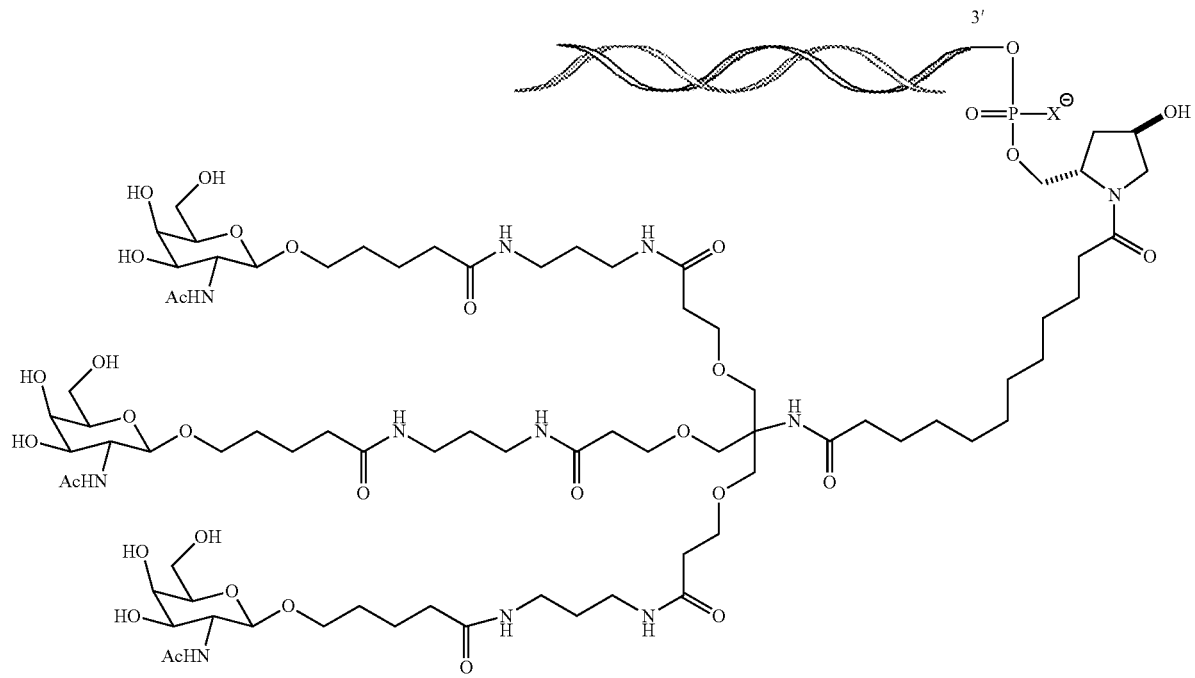

and, wherein X is O.

15. A double stranded ribonucleic acid (dsRNA) agent for inhibiting expression of Patatin-Like Phospholipase Domain Containing 3 (PNPLA3) in a cell, wherein the dsRNA agent comprises a sense strand and an antisense strand forming a double stranded region, wherein the sense strand differs by no more than 3 modified nucleotides from the nucleotide sequence of 5'-csasuuagGfaUfAfAfugucuuaugu-3' (SEQ ID NO:2648) and wherein the antisense strand differs by no more than 3 modified nucleotides from the nucleotide sequence of 5'-asCfsauaAfgAfCfauuaUfcCfuaaugsgsg-3' (SEQ ID NO:2732), wherein a, g, c and u are 2'-O-methyl (2'-OMe) A, G, C, and U respectively; Af, Gf, Cf and Uf are 2'-fluoro A, G, C and U respectively; and s is a phosphorothioate linkage.

16. The dsRNA agent of claim 15, wherein the sense strand differs by no more than 2 modified nucleotides from the nucleotide sequence of 5'-csasuuagGfaUfAfAfuguc-uuaugu-3' (SEQ ID NO:2648) and wherein the antisense strand differs by no more than 2 modified nucleotides from the nucleotide sequence of 5'-asCfsauaAf-gAfCfauuaUfcCfuaaugsgsg-3' (SEQ ID NO:2732).

17. The dsRNA agent of claim 15, wherein the sense strand differs by no more than 1 modified nucleotide from the nucleotide sequence of 5'-csasuuagGfaUfAfAfuguc-uuaugu-3' (SEQ ID NO:2648) and wherein the antisense strand differs by no more than 1 modified nucleotides from the nucleotide sequence of 5'-asCfsauaAf-gAfCfauuaUfcCfuaaugsgsg-3' (SEQ ID NO:2732).

18. The dsRNA agent of claim 15, wherein the dsRNA agent is conjugated to the ligand as shown in the following schematic 19. A double stranded ribonucleic acid (dsRNA) agent for inhibiting expression of Patatin-Like Phospholipase Domain Containing 3 (PNPLA3) in a cell, wherein the dsRNA agent comprises a sense strand and an antisense strand forming a double stranded region, wherein the sense strand comprises the nucleotide sequence of 5'-csasuuagGfaUfAfAfuguc-uuaugu-3' (SEQ ID NO:2648) and wherein the antisense strand comprises the nucleotide sequence of 5'-asCfsauaAf-gAfCfauuaUfcCfuaaugsgsg-3' (SEQ ID NO:2732), wherein a, g, c and u are 2'-O-methyl (2'-OMe) A, G, C, and U respectively; Af, Gf, Cf and Uf are 2'-fluoro A, G, C and U respectively; and s is a phosphorothioate linkage.

20. The dsRNA agent of claim 19, wherein the sense strand comprises the nucleotide sequence of 5'-csa-suuagGfaUfAfAfugucuuauguL96-3' (SEQ ID NO:2648) and wherein the antisense strand comprises the nucleotide sequence of 5'-asCfsauaAfgAfCfauuaUfcCfuaaugsgsg-3' (SEQ ID NO:2732), wherein a, g, c and u are 2'-O-methyl (2'-OMe) A, G, C, and U respectively; Af, Gf, Cf and Uf are 2'-fluoro A, G, C and U respectively; s is a phosphorothioate linkage, and L96 is N-[tris(GalNAc-alkyl)-amidodecanoyl)]-4-hydroxyprolinol.

21. The dsRNA agent of claim 19, wherein the 3'-end of the sense strand is conjugated to a ligand as shown in the following schematic:

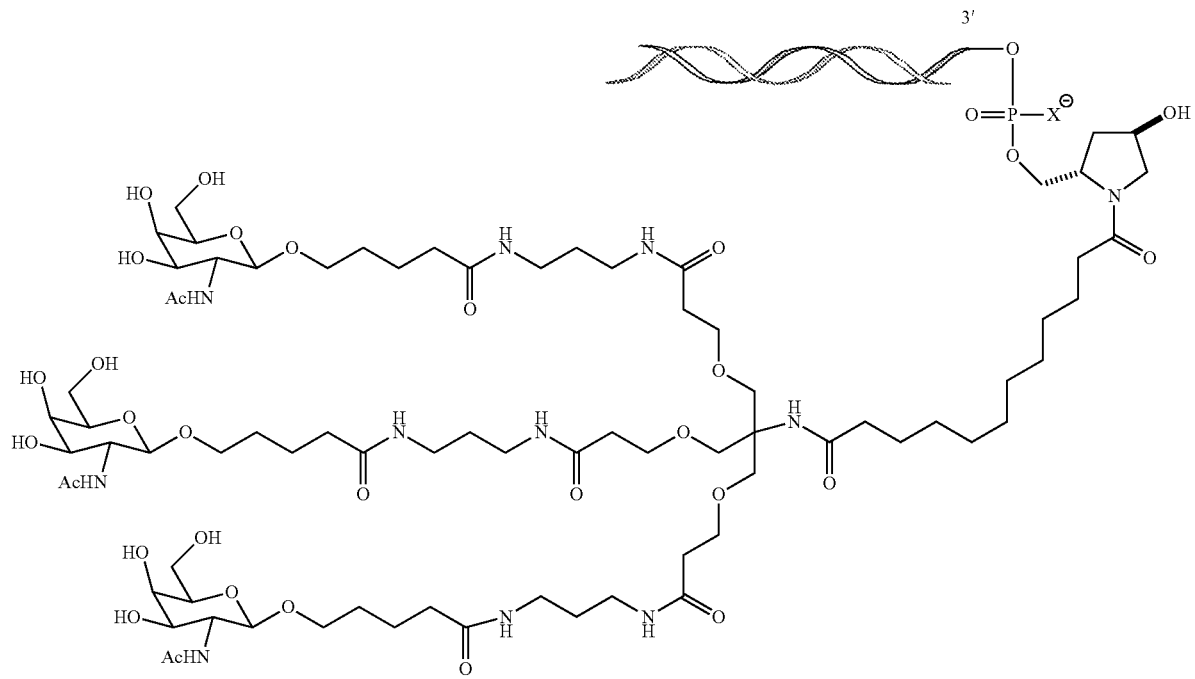

and, wherein X is O.

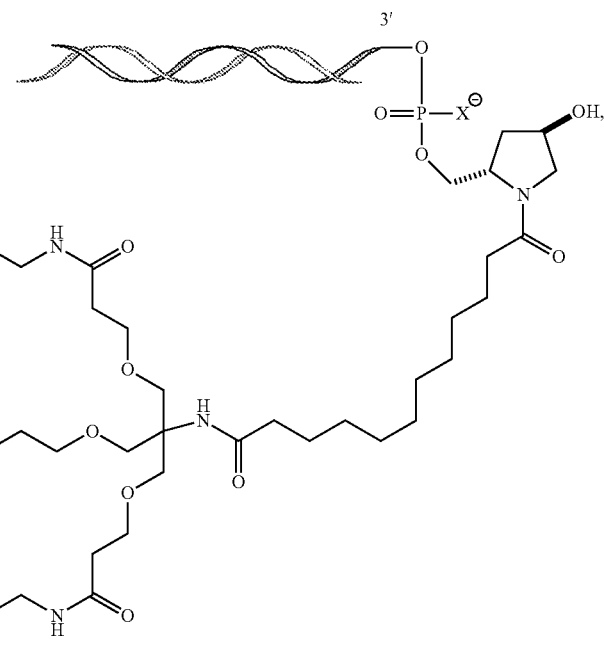
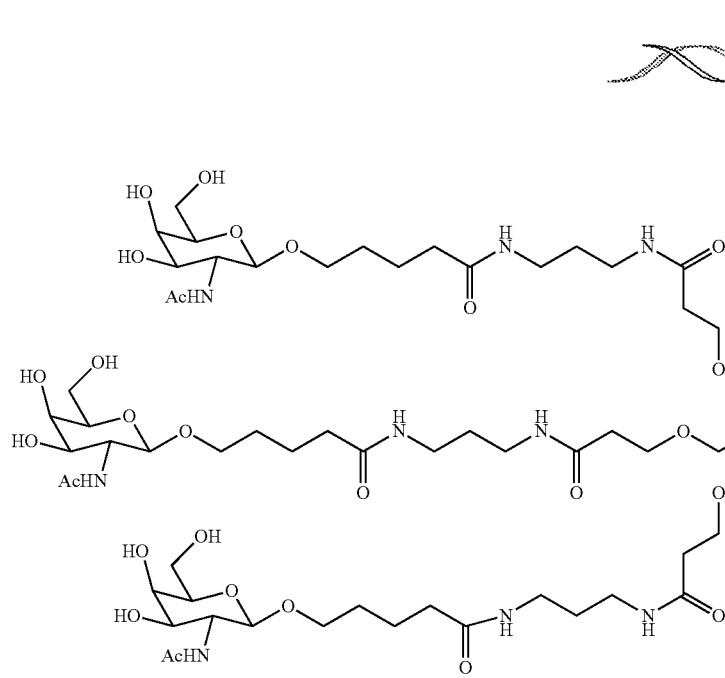

wherein X is O.

22. A double stranded ribonucleic acid (dsRNA) agent for inhibiting expression of Patatin-Like Phospholipase Domain Containing 3 (PNPLA3) in a cell, wherein the dsRNA agent comprises a sense strand and an antisense strand forming a double stranded region, wherein the sense strand consists of the nucleotide sequence of 5'-csasuuagGfaUfAfAfuguc-uuaugu-3' (SEQ ID NO:2648) and wherein the antisense strand consists of the nucleotide sequence of 5'-asCfsauaAf-gAfCfauuaUfcCfuaaugsgsg-3' (SEQ ID NO:2732), wherein a, g, c and u are 2'-O-methyl (2'-OMe) A, G, C, and U respectively; Af, Gf, Cf and Uf are 2'-fluoro A, G, C and U respectively; and s is a phosphorothioate linkage; and wherein the 3'-end of the sense strand is conjugated to a ligand as shown in the following schematic:

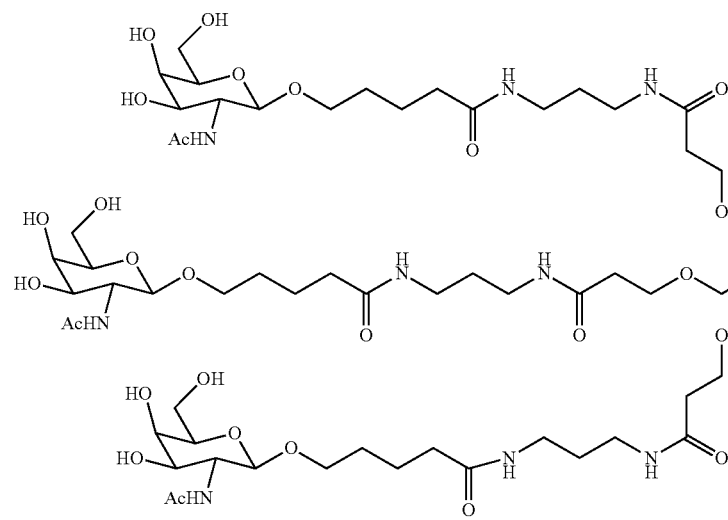

wherein X is O.

23. A pharmaceutical composition for inhibiting expression of a gene encoding Patatin-Like Phospholipase Domain Containing 3 (PNPLA3) comprising the dsRNA agent of claim 1.

24. The pharmaceutical composition of claim 23, wherein dsRNA agent is in an unbuffered solution.

25. The pharmaceutical composition of claim 24, wherein the unbuffered solution is saline or water.

26. The pharmaceutical composition of claim 23, wherein said dsRNA agent is in a buffer solution.

27. The pharmaceutical composition of claim 26, wherein the buffer solution comprises acetate, citrate, prolamine, carbonate, or phosphate or any combination thereof.

28. The pharmaceutical composition of claim 27, wherein the buffer solution is phosphate buffered saline (PBS).

29. A pharmaceutical composition for inhibiting expression of a gene encoding Patatin-Like Phospholipase Domain Containing 3 (PNPLA3) comprising the dsRNA agent of claim 21.

30. A pharmaceutical composition for inhibiting expression of a gene encoding Patatin-Like Phospholipase Domain Containing 3 (PNPLA3) comprising the dsRNA agent of claim 22.

* * * * *